US008124109B2

(12) United States Patent
Kickhoefer et al.

(10) Patent No.: US 8,124,109 B2
(45) Date of Patent: Feb. 28, 2012

(54) VAULT COMPOSITIONS FOR IMMUNIZATION AGAINST CHLAMYDIA GENITAL INFECTION

(75) Inventors: Valerie A. Kickhoefer, Sherman Oaks, CA (US); Leonard H. Rome, Tarzana, CA (US); Kathleen A. Kelly, Pacific Palisades, CA (US); Cheryl I. Champion, Los Angeles, CA (US)

(73) Assignee: The Regents of the University of California, Oakland, CA (US)

( * ) Notice: Subject to any disclaimer, the term of this patent is extended or adjusted under 35 U.S.C. 154(b) by 19 days.

(21) Appl. No.: 12/467,255

(22) Filed: May 15, 2009

(65) Prior Publication Data

US 2009/0304751 A1 Dec. 10, 2009

Related U.S. Application Data

(60) Provisional application No. 61/053,623, filed on May 15, 2008.

(51) Int. Cl.
*A61K 39/118* (2006.01)
(52) U.S. Cl. .................... 424/263.1; 424/193.1; 514/1.1
(58) Field of Classification Search ........................ None
See application file for complete search history.

(56) References Cited

U.S. PATENT DOCUMENTS

| 6,110,740 | A | 8/2000 | Rome et al. | |
| 6,156,879 | A | 12/2000 | Rome et al. | |
| 6,555,347 | B1 | 4/2003 | Rome et al. | |
| 7,482,319 | B2 * | 1/2009 | Rome et al. | 514/1.1 |

FOREIGN PATENT DOCUMENTS

| WO | WO 99/49025 A2 | 9/1999 |
| WO | WO 99/62547 A1 | 12/1999 |
| WO | WO 2004/081533 | 9/2004 |

OTHER PUBLICATIONS

Beagley, K.W. et al., "*Chlamydia Trachomatis* Infection: Incidence, Health Costs and Prospects for Vaccine Development," Journal of Reproductive Immunology, Aug. 2000, pp. 47-68, vol. 48, No. 1.
Berry, L. J. et al., "Transcutaneous Immunization with Combined Cholera Toxin and CpG Adjuvant Protects Against *Chlamydia muridarum* Genital Tract Infection," Infection and Immunology, Feb. 2004, pp. 1019-1028, vol. 72, No. 2.
Blander, J. M. et al., "On Regulation of Phagosome Maturation and Antigen Presentation," Nature Immunology, Oct. 2006, pp. 1029-1035, vol. 7, No. 10.
Brunham, R. C. et al., "Immunology of Chlamydia Infection: Implications for a *Chlamydia Trachomatis* Vaccine," Nature Reviews Immunology, Feb. 2005, pp. 149-161, vol. 5, No. 2.
Brunham, RCP, et al., "The Unexpected Impact of a *Chlamydia trachomatis* Infection Control Program on Susceptibility to Reinfection," Journal of Infectious Diseases, Nov. 15, 2005, pp. 1836-1844, vol. 192.
Christiansen, G. et al., "Is a Chlamydia Vaccine a Reality?" Best Practice & Research Clinical Obstetrics and Gynaecology, 2002, pp. 889-900, vol. 16, No. 6.
Chugani, D.C. et al, "Evidence That Vault Ribonucleoprotein Particles Localize to the Nuclear Pore Complex," Journal of Cell Science, 1993, pp. 23-29, vol. 106.
Cotter, T.W. et al., "Dissemination of *Chlamydia trachomatis* Chronic Genital Tract Infection in Gamma Interferon Gene Knockout Mice," Infection and Immunity, Jun. 1997, pp. 2145-2152, vol. 65, No. 6.
Dong-Ji, Z. et al., "Priming with *Chlamydia Trachomatis* Major Outer Membrane Protein (MOMP) DNA Followed by MOMP ISCOM Boosting Enhances Protection and is Associated with Increased Immunoglobulin A and Th1 Cellular Immune Responses," Infection and Immunity, Jun. 2000, pp. 3074-3078, vol. 68, No. 6.
Eko, F.O. et al., "A Novel Recombinant Multisubunit Vaccine Against Chlamydia," The Journal of Immunology, 2004, pp. 3375-3382, vol. 173.
Eko, F.O. et al., "Recombinant *Vibrio Cholerae*Ghosts as a Delivery Vehicle for Vaccinating Against *Chlamydia Trachomatis*," Vaccine, Apr. 2, 2003, pp. 1694-1703, vol. 21, Issue 15.
Gallichan, W.S. et al., "Long-Term Immunity and Protection Against Herpes Simplex Virus Type 2 in the Murine Female Genital Tract After Mucosal but Not Systemic Immunization," The Journal of Infectious Diseases, May 1998, pp. 1155-1161, vol. 177, No. 5.
Grayston, J.T. et al., "Field Studies of Protection from Infection by Experimental Trachoma Virus Vaccine in Preschool-aged Children on Taiwan," Proc Soc Exp Biol Med, Mar. 1963, pp. 589-595, vol. 112.
Hackstadt, T., Chapter 5: Cell Biology, Chlamydia: Intracellular Biology, Pathogenesis, and Immunity, RS Stephens Ed., ASM press, 1999, pp. 101-138.
Hawkins, R. et al., "A *Chlamydia trachomatis*-Specific Th2 Clone Does Not Provide Protection against a Genital Infection and Displays Reduced Trafficking to the Infected Genital Mucosa," Infection and Immunity, Sep. 2002, pp. 5132-5139, vol. 70, No. 9.
He, Q. et al., "Live-Attenuated Influenza Viruses as Delivery Vectors for Chlamydia Vaccines," Immunology, 2007, pp. 28-37, vol. 122, No. 1.
Heijnen, I. A. et al., "Antigen Targeting to Myeloid-Specific Human Fc Gamma RI/CD64 Triggers Enhanced Antibody Responses in Transgenic Mice," J. Clin. Invest., Jan. 15, 1996, pp. 331-338, vol. 97, No. 2.
Hess, J., Exploiting the Immune System: Toward New Vaccines Against Intracellular Bacteria, Advances in Immunology, 2000, pp. 1-88, vol. 75.
Ifere, G.O. et al., "Immunogenicity and Protection Against Genital Chlamydia Infection and its Complications by a Multisubunit Candidate Vaccine," J. Microbiol. Immunol. Infect., 2007, pp. 188-200, vol. 40, No. 3.
Infection and Its Complications by a Multisubunit Candidate Vaccine, J. Microbiol. Immunol. Infect., 2007, pp. 188-200, vol. 40, No. 3.

(Continued)

*Primary Examiner* — Jennifer Graser
(74) *Attorney, Agent, or Firm* — Fenwick & West LLP

(57) ABSTRACT

Methods and compositions are provided herein for immunizing a subject against Chlamydial genital infection by administering to the subject an effective amount of a Chlamydial immunogenic peptide or an immunogenic fragment or variant thereof incorporated within a vault-like particle carrier. In some aspects, the vault-like-particles are administered to the nasal mucosa. The methods and compositions advantageously exhibit enhanced ability to induce cell-mediated immunity and/or antibody-based immunity at mucosal surfaces while reducing inflammation associated with *Chlamydia* infection.

5 Claims, 5 Drawing Sheets

OTHER PUBLICATIONS

Igietseme, J.U. et al., "Resolution of Murine Chlamydial Genital Infection by the Adoptive Transfer of a Biovar-Specific, $TH_1$ Lymphocyte Clone," Regional Immunology, Nov./Dec. 1993, pp. 317-324, vol. 5, No. 6.

Igietseme, J.U. et al., "Induction of Protective Immunity Against *Chlamydia trachomatis* Genital Infection by a Vaccine Based on Major Outer Membrane Protein-Lipophilic Immune Response-Stimulating Complexes," Infection and Immunity, Dec. 2000, pp. 6798-6806, vol. 68, No. 12.

Izquierdo, M.A. et al., "Broad Distribution of the Multidrug Resistance-Related Vault Lung Resistance Protein in Normal Human Tissues and Tumors," American Journal of Pathology, Mar. 1996, pp. 877-887, vol. 148, No. 3.

Kedersha, N. L. et al., "Vaults. III. Vault Ribonucleoprotein Particles Open Into Flower-Like Structures with Octagonal Symmetry," *J. Cell Biol.*, Jan. 15, 1991, pp. 225-235, vol. 112, No. 2.

Kelly, K.A. et al., "Identification of Homing Receptors That Mediate the Recruitment of CD4 T Cells to the Genital Tract Following Intravaginal Infection with *Chlamydia trachomatis*," Infection and Immunity, Dec. 1997, pp. 5198-5208, vol. 65, No. 12.

Kelly, K.A. et al., "Initial Route of Antigen Administration Alters the T-Cell Cytokine Profile Produced in Response to the Mouse Pneumonitis Biovar of *Chlamydia trachomatis* Following Genital Infection," Infection and Immunity, Dec. 1996, pp. 4976-4983, vol. 64, No. 12.

Kickhoefer, V.A. et al. "Engineering of Vault Nanocapsules with Enzymatic and Fluorescent Properties." Proceedings of the National Academy of Sciences, Mar. 7, 2005, pp, 4348-4352, vol. 102, No. 12.

Kickhoefer, V. A. et al., "The 193-Kd Vault Protein, Vparp, Is a Novel Poly(AdpRibose) Polymerase," J. Cell Biol., Sep. 6, 1999, pp. 917-928, vol. 146, No. 5.

Kong, L. et al., "Structure of the Vault, a Ubiquitous Cellular Component," *Structure*, Apr. 15, 1999, pp. 371-379, vol. 7, Issue 4.

Kowalski, M.P. et al., "Host Resistance to Lung Infection Mediated by Major Vault Protein in Epithelial Cells," Science, 2007, pp. 130-132, vol. 317.

Kozlowski, P.A. et al., "Differential Induction of Mucosal and Systemic Antibody Responses in Women After Nasal, Rectal, or Vaginal Immunization: Influence of the Menstrual Cycle," The Journal of Immunology, 2002, pp. 566-574 vol. 169, No. 1.

Laemmli, U.K., "Cleavage of Structural Proteins During the Assembly of the Head of Bacteriophage T4," Nature, Aug. 15, 1970, pp. 680-685, vol. 227.

Liu, W. et al., "Prostaglandin $E_2$ Modulates Dendritic Cell Function During Chlamydial Genital Infection," Immunology, 2007, pp. 290-303, vol. 123.

Longbottom, D., "Chlamydial Vaccine Development," Journal of Medical Microbiology, Jul. 2003, pp. 537-540, vol. 52.

Lutz, M.B. et al., "An Advanced Culture Method for Generating Large Quantities of Highly Pure Dendritic Cells from Mouse Bone Marrow," Journal of Immunological Methods, Feb. 1, 1999, pp. 77-92, vol. 223, Issue 1.

Macmillan, L. et al., "A Recombinant Multivalent Combination Vaccine Protects Against Chlamydia and Genital Herpes," FEMS Immunology & Medical Microbiology, Feb. 2007, pp. 46-55, vol. 49, No. 1.

Maxion, H.K. et al., "The Infecting Dose of *Chlamydia Muridarum*-Modulates the Innate Immune Response and Ascending Infection," Infection and Immunity, Nov. 2004, pp. 6330-6340, vol. 72, No. 11.

Mestecky, J., "The Common Mucosal Immune System and Current Strategies for Induction of Immune Responses in External Secretions," Journal of Clinical Immunology, 1987, pp. 265-276, vol. 7, No. 4.

Mikyas, Y. et al., "Cryoelectron Microscopy Imaging of Recombinant and Tissue Derived Vaults: Localization of the MVP N. Termini and VPARP," Journal of Molecular Biology, Nov. 12, 2004, pp. 91-105, vol. 344, Issue 1.

Moore, T. et al., "FC Receptor-Mediated Antibody Regulation of T Cell Immunity Against Intracellular Pathogens," The Journal of Infectious Diseases, Aug. 15, 2003, pp. 617-624, vol. 188, No. 4.

Morrison, S.G. et al., "In Situ Analysis of the Evolution of the Primary Immune Response in Murine *Chlamydia trachomatis* Genital Tract Infection," Infection and Immunity, May 2000, pp. 2870-2879, vol. 68, No. 5.

Morrison, R.P. et al., "Gene Knockout Mice Establish a Primary Protective Role for Major Histocompatibility Complex Class II-restricted Responses in Chlamydia Trachomatis Genital Tract Infection," Infection and Immunity, 1995, pp. 4661-4668, vol. 63,No. 12.

Morrison, S.G. et al., "A Predominant Role for Antibody in Acquired Immunity to Chlamydial Genital Tract Reinfection," The Journal of Immunology, 2005, pp. 75367542, vol. 175, No. 11.

Murthy, A.K. et al., "Intranasal Vaccination with a Secreted Chlamydial Protein Enhances Resolution of Genital *Chlamydia muridarum* Infection, Protects against Oviduct Pathology, and Is Highly Dependent upon Endogenous Gamma Interferon Production," Infection and Immunity, Feb. 2007, pp. 666-676, vol. 75, No. 2.

Neutra, M. et al., "Mucosal vaccines: the Promise and the Challenge," Nature Reviews Immunology, Feb. 2006, pp. 148-158, vol. 6.

O'Connell, C.M. et al., "Plasmid-Deficient *Chlamydia muridarum* Fail to Induce Immune Pathology and Protect against Oviduct Disease," The Journal of Immunology, 2007, pp. 4027-4034, vol. 179, No. 6.

Oliveira, M.L.S., "Intranasal Vaccines for Protection against Respiratory and Systemic Bacterial Infections," Expert Review of Vaccines, Jun. 2007, pp. 419-429, vol. 6, No. 3.

Pal, S. et al., "Induction of Protective Immunity Against a *Chlamydia trechomatis* Genital Infection in Three Genetically Distinct Strains of Mice," Immunology, Nov. 2003, pp. 368-375, vol. 110, Issue 3.

Pal, S. et al., "Vaccination with the *Chlamydia trachomatis* Major Outer Membrane Protein Can Elicit an Immune Response as Protective as That Resulting from Inoculation with Live Bacteria," Infection and Immunity, Dec. 2005, pp. 81538160, vol. 73, No. 12.

Pal, S. et al., "Immunization with the *Chlamydia trachomatis* Major Outer Membrane Protein, Using Adjuvants Developed for Human Vaccines, Can Induce Partial Protection in a Mouse Model Against a Genital Challenge,"Vaccine, Feb. 6, 2006, pp. 766-775, vol. 24, Issue 6.

Pal, S. et al., "Immunization with the *Chlamydia trachomatis* Major Outer Membrane Protein, Using the Outer Surface Protein a of Borrelia burgdorferi as an Adjuvant, Can Induce Protection Against a Chlamydial Genital Challenge," Vaccine, Mar. 28, 2003, pp. 1455-1465, vol. 21, Issues 13-14.

Perry, L.L. et al., "Immunity to Chlamydia trachomatis is Mediated by T Helper 1 Cells Through IFN-gamma-dependent and -independent Pathways," The Journal of Immunology, 1997, pp. 3344-3352, vol. 158, Issue 7.

Rank, R.G., "Models of Immunity," Chlamydia: Intracellular Biology, Pathogenesis and Immunity, ASM Press, 1999, Washington, DC.

Singh, S.R. et al., "Mucosa! Immunization with Recombinant MOMP Genetically Linked with Modified Cholera Toxin Confers Protection Against *Chlamydia trachomatis* Infection," Vaccine, Feb. 20, 2006, pp. 1213-1224, vol. 24, Issue 8.

Slesina, M. et al., "Movement of Vault Particles Visualized by GFP-Tagged Major Vault Protein," Cell Tissue Res., 2006, pp. 403-410, vol. 324.

Staats, H.F. et al., "Intranasal Immunization is Superior to Vaginal, Gastric, or Rectal Immunization for the Induction of Systemic and Mucosal Anti-HIV Antibody Responses," AIDS Research and Human Retroviruses, 1997, pp. 945-952, vol. 13, No. 11.

Stephen, A.G. et al., "Assembly of Vault-Like Particles in Insect Cells Expression Only the Majority Vault Protein," The Journal of Biological Chemistry, Jun. 29, 2001, pp. 23217-23220, vol. 276, No. 26.

"STDs in Adolescents and Young Adults," US Department of Health and Human Services DoSP. STD Surveillance, 1999. Atlanta, GA, 2000, pp. 51-58.

U.S. Appl. No. 12/252,200, filed Oct. 15, 2008, Rome et al.

U.S. Provisional Appl. No. 60/453,800, filed Mar. 20, 2003, Rome et al.

U.S. Provisional Appl. No. 60/079,634, filed Mar. 27, 1998, Rome et al.

Weinrich Olsen, a. et al., "Identification of Human T Cell Targets Recognized During *Chlamydia trachomatis* Genital Infection,"

Jour-nal of Infectious Diseases, Nov. 15, 2007, pp. 1546-1552, vol. 196, No. 10.

Zhang, Y.X. et al., "Protective Monoclonal Antibodies to Chlamydia trachomatis Serovar- and Serogroup-specific Major Outer Membrane Protein Determinants," Infect. Immun., Feb. 1989, pp. 636-638, vol. 57.

Zhang, D-J. et al., "DNA Vaccination with the Major Outer-Membrane Protein Gene Induces Acquired Immunity to Chlamydia trachomatis (Mouse Pneumonitis) Infection," The Journal of Infectious Diseases, Oct. 1997, pp. 1035-1040, vol. 176, No. 4.

Zuercher, a.W. et al., "Nasal-Associated Lymphoid Tissue Is a Mucosal Inductive Site for Virus-Specific Humoral and Cellular Immune Responses," The Journal of Immunology, 2002, pp. 1796-1803, vol. 168, No. 4.

* cited by examiner

VAULT COMPOSITIONS FOR IMMUNIZATION AGAINST CHLAMYDIA GENITAL INFECTION

CROSS-REFERENCE TO RELATED APPLICATION

The present application claims the benefit of U.S. provisional patent application No. 61/053,623, filed May 15, 2008, which is herein incorporated by reference in its entirety.

STATEMENT OF GOVERNMENT SUPPORT

This invention was made with United States Government support under National Institutes of Health Grant Nos. AI26328 AND EB004553 and National Science Foundation Grant No. MCB0210690. The United States Government has certain rights in this invention.

BACKGROUND

*C. trachomatis* is a gram-negative bacterium with an obligate intracellular developmental cycle. Sexually transmitted infections (STI) with *Chlamydia trachomatis* are common in the US, with approximately 3 million cases occurring annually and a 5% incidence in the adolescent population. Chlamydial STIs primarily cause local infections confined to epithelial cells in the female reproductive tract. However, *C. trachomatis* infections can also ascend to the upper genital tract (UGT) and induce an inflammatory response, leading to variety of complications that are associated with increased morbidity and reproductive dysfunction, including infertility. Antibiotic administration through screening programs can lower infection rates but may actually increase postinfection complications in females (Brunham et al., *J. Infect. Dis.*, 192:1836-44 (2005)). Hence, a vaccine protecting against *C. trachomatis* infection would be highly desirable.

$CD4^+$ T-cells expressing the $\alpha\beta+$ T-cell receptor ($TCR\alpha\beta+$) dominate the local lymphocytic infiltrate of patients infected with *C. trachomatis* (Morrison et al., *Infect. Immun.*, 68(5):2870-9 (2000); Kelly et al., *Infect. Immun.*, 65:5198-208 (1997)) and are necessary for the resolution of *Chlamydia* genital infection (Cotter et al., *Infect. Immun.*, 65(6):2145-52 (1997); Perry et al., *J Immunol.*, 158:3344-52 (1997); Morrison et al., *Infect. Immun.*, 63(12):4661-8 (1995)). Resolution is dependent on the secretion of gamma interferon (IFNγ) (Perry et al., *J Immunol.*, 158:3344-52 (1997); Hawkins et al., *Infect. Immun.*, 70(9):5132-9 (2000); Igietseme et al., *Regional Immunol.*, 5:317-24 (1993)) and can be mediated by transferring IFNγ-secreting CD4+ T cells (Th1 cells) to infected subjects (Hawkins et al., *Infect. Immun.*, 70(9):5132-9 (2000); Murthy et al., *Infect. Immun.*, 75(2):666-76 (2007)). In addition, antibody responses can enhance cell-mediated immune protection against *C. trachomatis* genital infection (Morrison et al., *J. Immunol.*, 175 (11):7536-42 (2005)). Thus, a vaccine against *C. trachomatis* would preferably elicit both a Th1 cell-mediated response and an antibody response against *C. trachomatis* in the reproductive mucosa while minimizing inflammation associated with *C. trachomatis* infection.

The Chlamydial protein most studied as a candidate antigen for a Chlamydiavaccine is the Chlamydial major outer membrane protein (MOMP), a 40 kDa integral membrane protein which is the predominant Chlamydial surface protein. While other Chlamydial surface proteins are immunogenic, antibodies against such proteins have not been found to be protective (e.g., Zhang et al., *Infect. Immun.*, 57:636-638 (1989)). A common approach for vaccinating against Chlamydial infection is to stimulate the central immune system by parenteral administration of a subunit vaccine (e.g., Macmillan et al., *FEMS Immunology & Medical Microbiology*, 49(1):46-55 (2007); Ifere et al., *J. Microbiol. Immunol. Infect.*, 40(3):188-200 (2007)). While such conventionally administered vaccines are capable of providing some protection against infertility (Pal et al., *Infect. Immun.*, 73(12):8153-60 (2005)) they are difficult to produce and ineffective in many subjects.

In contrast to parenteral administration, vaccine administration to mucosal tissues induces strong cellular responses at mucosal surfaces (Neutra et al., *Nat. Rev. Immunol.*, 6(2):148-58 (2006)). Moreover, stimulating the inductive site at a mucosal surface produces immune responses at distant mucosal surfaces (Mestecky, *J. Clin. Immunol.*, 7:265-76 (1987)). For example, stimulating inductive immune sites (NALT) in the nasal mucosa (Zuercher et al., *J. Immunol.*, 168(4):1796-803 (2002)) can induce greater antibody levels at vaginal surfaces (Kozlowski et al., *J. Immunol.*, 169(1):566-74 (2002); Staats et al., *AIDS Res. Hum. Retroviruses*, 13(11):945-52 (1998)). Immunization of the nasal mucosae can also produce cell-mediated responses in the genital tract. For example, intranansal immunization produced a cytotoxic T lymphocyte (CTL) response against HSV-2 in the genital tract and induced long-lasting protection against reinfection (Gallichan et al., *J. Infect. Dis.*, 177(5):1155-61 (1998)). Recently, intranasal immunization with a Chlamydial peptide provided superior protection against infection and reduced hydrosalpinx following Chlamydial infection (Murthy et al., *Infect. Immun.*, 75(2):666-76 (2007); He et al., *Immunology*, 122(1):28-37 (2007)).

Thus, there is a need in the art for a *Chlamydia* vaccine which is suitable for administration to the nasal mucosae and capable of inducing both cellular and antibody-based immune responses and providing protective immunity against infection while minimizing inflammation in the subject.

SUMMARY

In some aspects, methods are provided herein for treating and/or preventing Chlamydial infection in a subject, the methods comprising administering to the subject an effective amount of a Chlamydial immunogenic peptide or an immunogenic fragment or variant thereof incorporated within a vault-like particle.

In further aspects, pharmaceutical compositions are provided herein for immunizing a subject against *C. trachomatis* genital infection, the compositions comprising a Chlamydial immunogenic peptide or an immunogenic fragment or variant thereof incorporated within a vault-like particle, and at least one pharmaceutically acceptable excipient.

In yet further aspects, methods are provided herein for immunizing a subject against Chlamydial genital infection, the methods comprising administering to the subject an effective amount of a Chlamydial immunogenic peptide or an immunogenic fragment or variant thereof incorporated within a vault-like particle.

In some preferred aspects, the immunogenic peptide is MOMP.

probed with an antibody against the VD1 region of MOMP (MoPn-40) and antisera against MVP (rabbit IgG). c). ELISA assay configured with vaults with or without the "z" domain and reacted with mouse IgG or IgA. Data points represent duplicates, SD=0.004-0.034 nm.

Figure 1:
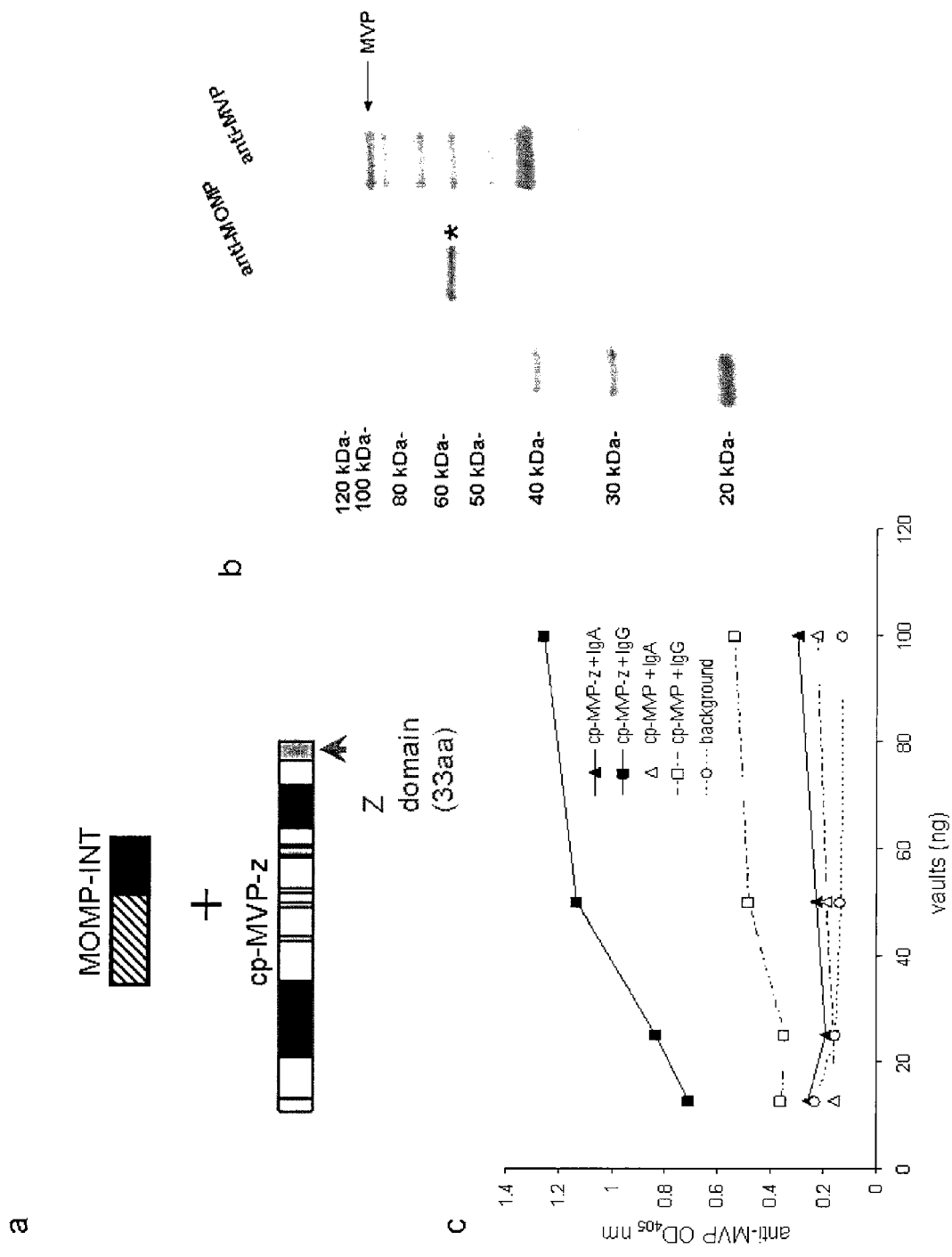
FIG. 1. Design of a ChlamydiaVault. a) Constructs used to prepare recombinant vaults containing MOMP using baclovirus. b) Western blot of a ChlamydiaVaults (5 µg/lane)
Figure 2:
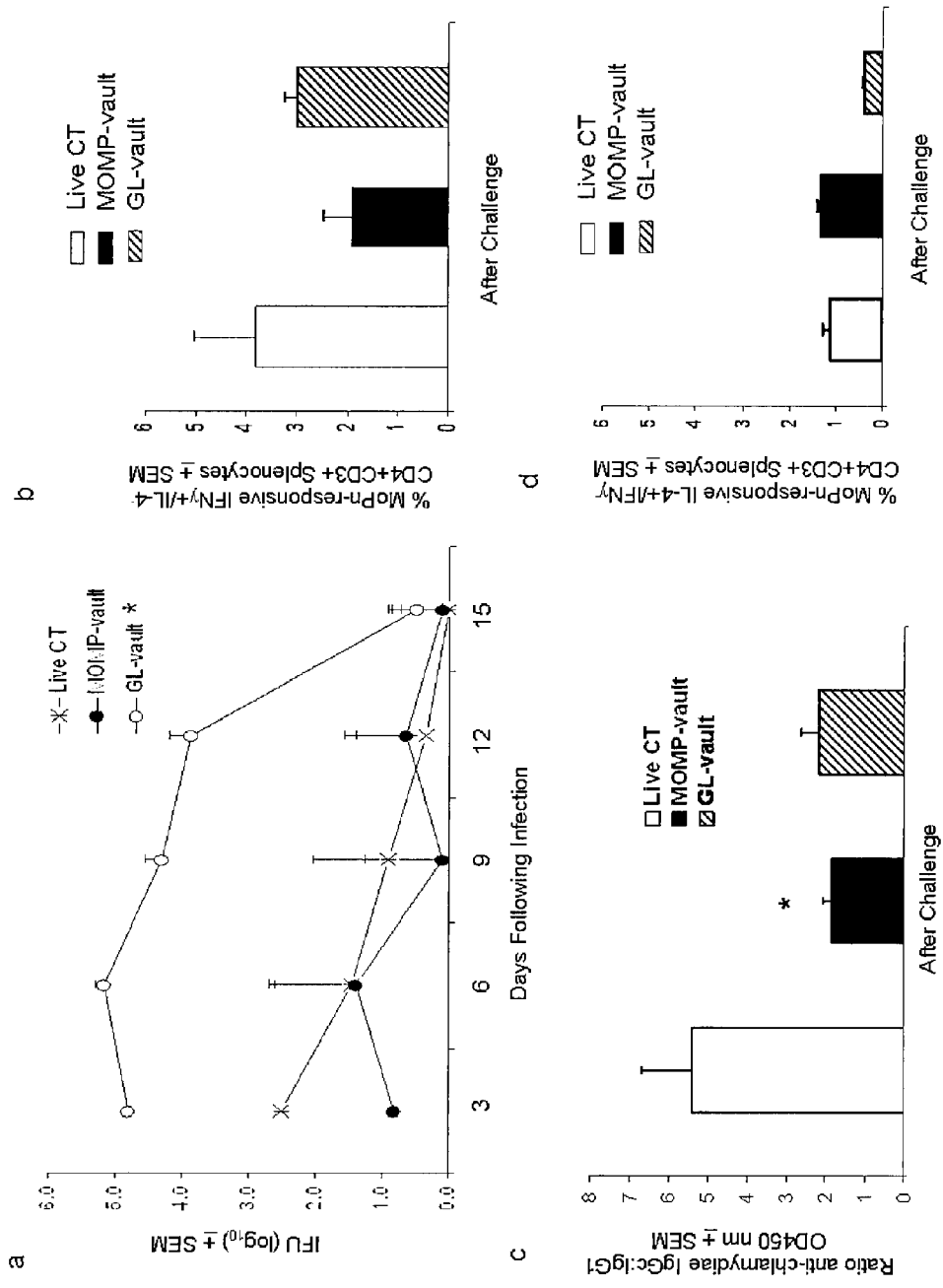

FIG. 2. Immunization with ChlamydiaVaults significantly reduced bacterial burden following chlamydial genital infection. a) The course of infection was statistically reduced in the MOMP-vault immunized group compared to the control GL-vault immunized group. (two-way RM ANOVA (p, 0.005), Dunn's one-way ANOVA showed that the positive control and the MOMP-vault immunized group was statistically different from the GL-vault immunized group but they were not different from each other; p<0.05) b). The percentage of anti-chlamydial responsive Th1 cells among CD4+CD3+ splenocytes measured day 15 after genital infection among the different immunization groups. Bars represent means of individual mice. At least 10,000 events were collected on a flow cytometer and gated on CD4+CD3+ cells. c) Bars represent the means of the ratio of antichlamydiae IgGc:IgG1 in serum collected 15 days after genital infection. *, p=0.02. d) The percentage of anti-chlamydial responsive Th2 cells among CD4+CD3+ splenocytes measured day 15 after genital infection among the different immunization groups. Bars represent means of individual mice. At least 10,000 events were collected on a flow cytometer and gated on CD4+CD3+ cells. N: CT=6, MOMP-vault=6, GL-vault=5. Data are representative of two experiments.

Figure 3:
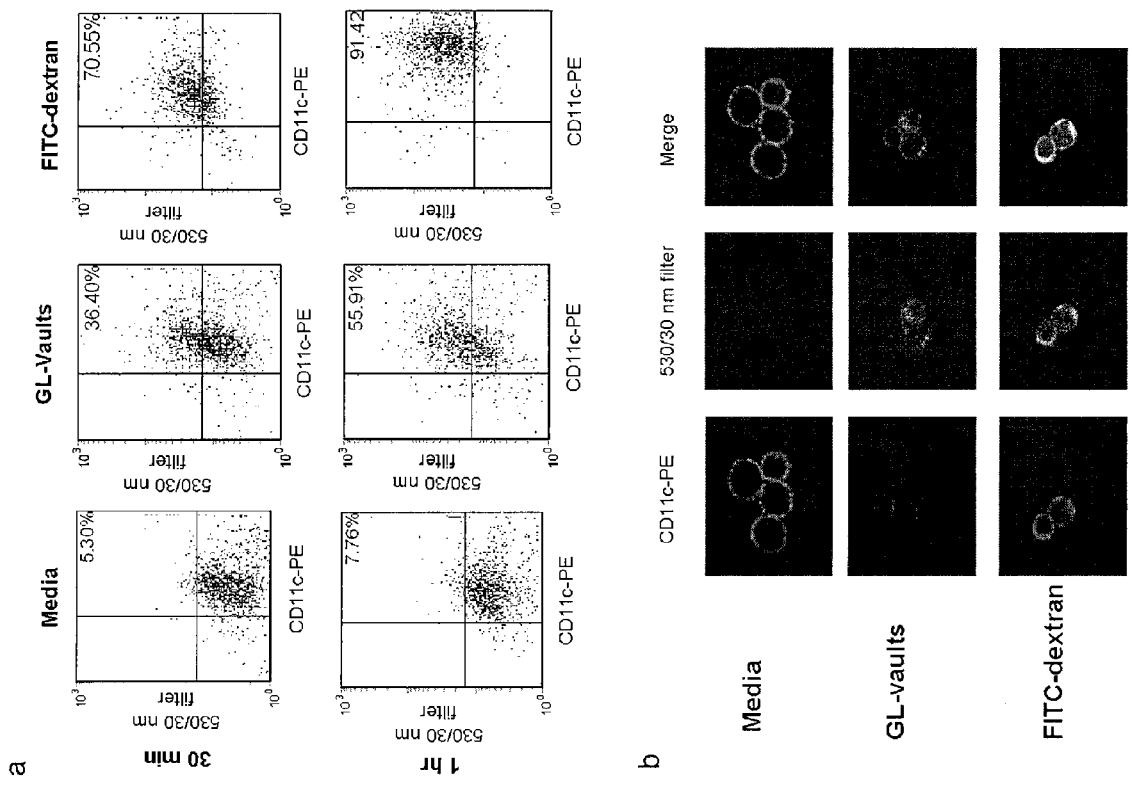

FIG. 3. Dendritic cells are efficient at incorporating vaults. a) BMDCs (1×106) were incubated with media, CP-MVP-Z/INT-GL vaults (500 μg) or FITCdextran (250 μg) at 37° C. for the indicated times. Cells were stained for a marker on DCs (CD11c-PE) and analyzed using a flow cytometer. Shown is a representative of three experiments. b) BMDCs (1×106) were incubated with media, CP-MVP-Z/INT-GL vaults (0.5 mg) or FITC-dextran (250 μg) at 37° C. for 30 min-2 hrs. Cells were stained for a marker of DCs (CD11c-PE, red). Arrows designate cells containing fluorescent particles (green). Shown is a representative of three experiments.

Figure 4:
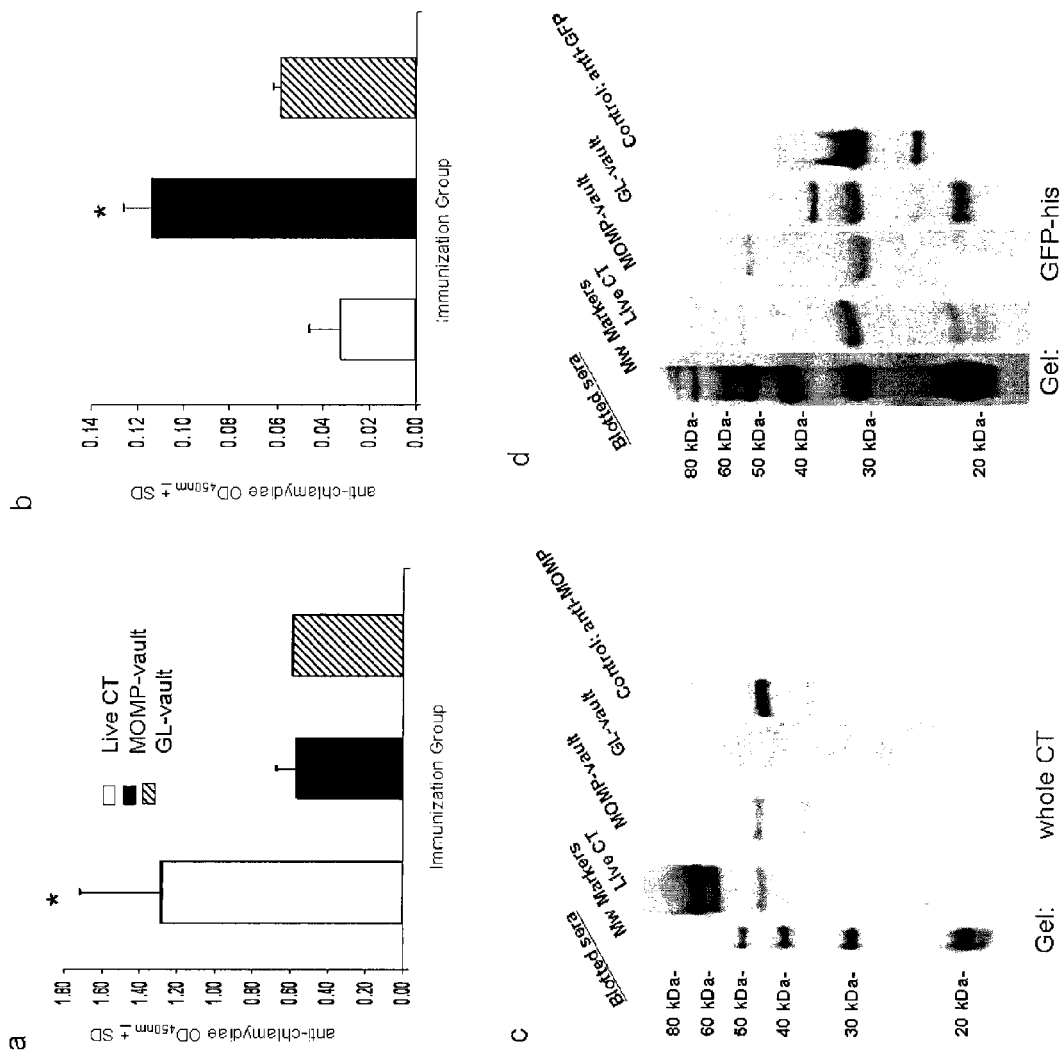

FIG. 4. Immunization with vaults induces antibody against the contained immunogen. Serum was collected from mice 2 weeks after the indicated immunization. ELISA assay individual sera against a) UV-inactivated Chlamydiae or b) MOMP peptide. Bars represent the means of the anti-Chlamydiae. * p<0.04. IgG levels in serum * p<0.001. Western blot (15% SDS-PAGE) reactivity against c) whole UV-inactivated Chlamydiae or d) his-tagged GFP and probed with pooled sera from the indicated immunization regimen or control antisera as indicated above. Lanes contain ~10 μg of whole CT or GFP-his. n=4-6 mice per group. Representative of two independent experiments.

Figure 5:
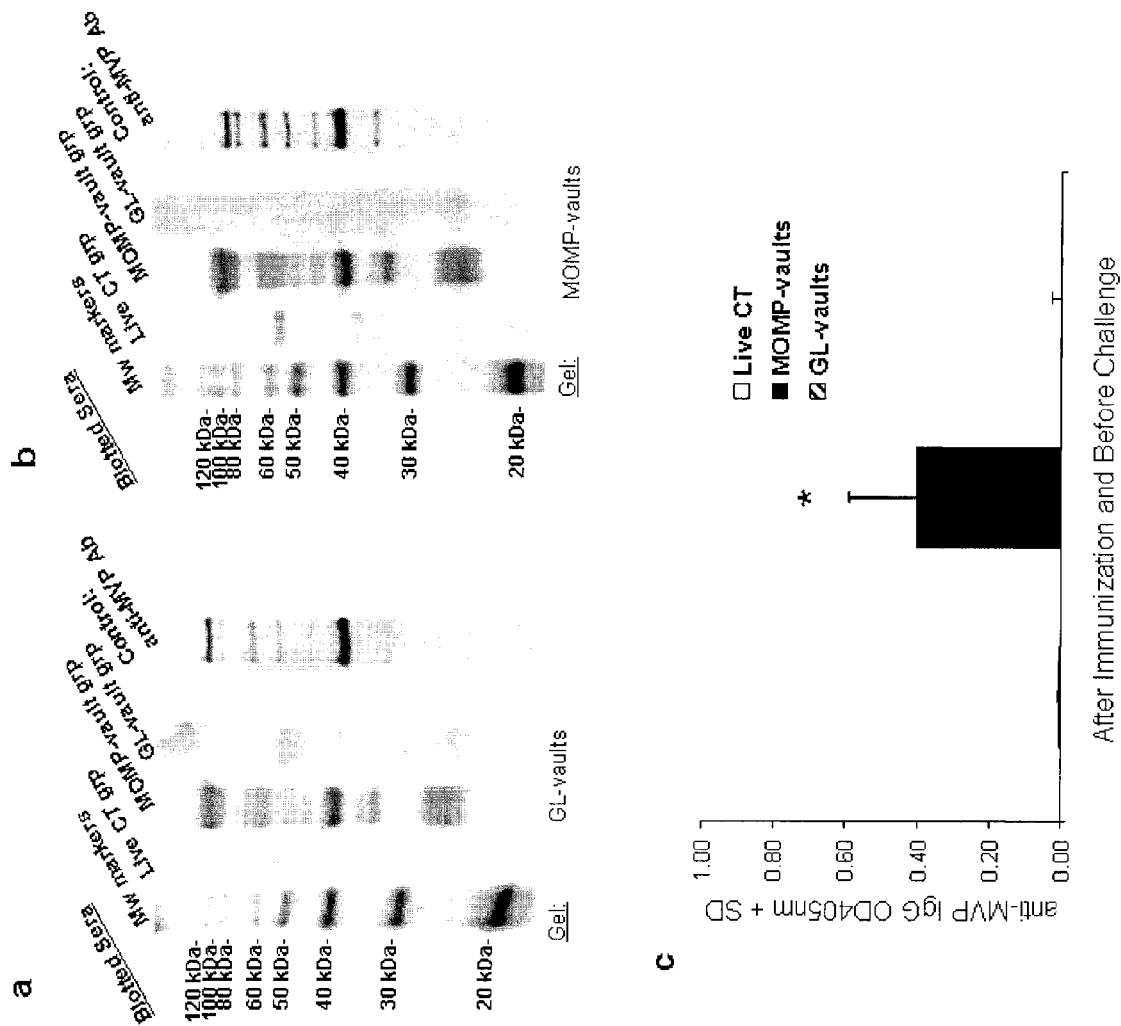

FIG. 5. Development of anti-MVP serum antibody is dependent on the peptide contained within the vault. Serum was collected from mice 2 weeks after the indicated immunization. Western blot (15% SDS-PAGE) reactivity against a) GL-vaults or b) MOMP-vaults and probed with pooled sera from mice collected 2 weeks after the indicated immunization regimen or control antisera as indicated above. Lanes contain ~10 μg of GL-vaults or MOMP-vaults. c) ELISA assay of pooled sera against vault-coated plates. Bars represent the mean of 4-6 mice per group. * p<0.001. Representative of two independent experiments.

DETAILED DESCRIPTION

The present invention is related to novel *Chlamydia* vaccines comprising an immunogenic peptide in association with a vault-based carrier. In some preferred aspects, the vaccines comprise the Chlamydial major outer membrane protein (MOMP) or an immunogenic fragment or variant thereof within the hollow interior of a barrel-shaped vault nanocapsule. The vaccines are preferably suitable for administration to a mucosal surface, such as but not limited to the nasal mucosae, and capable of inducing a cell-mediated immune response in mucosal tissues.

Vaults are ubiquitous, highly conserved ribonucleoprotein particles found in nearly all eukaryotic tissues and cells, including dendritic cells (DCs), endometrium, and lung, and in phylogeny as diverse as mammals, avians, amphibians, the slime mold *Dictyostelium discoideum*, and the protozoan *Trypanosoma brucei* (Izquierdo et al., *Am. J. Pathol.*, 148(3): 877-87 (1996)). Vaults have a hollow, barrel-like structure with two protruding end caps and an invaginated waist. Regular small openings surround the vault cap. These openings are large enough to allow small molecules and ions to enter the interior of the vault. Vaults have a mass of about 12.9±1 MDa (Kedersha et al., *J. Cell Biol.*, 112(2):225-35 (1991)) and overall dimensions of about 42×42×75 nm (Kong et al., *Structure*, 7(4):371-9 (1999)). The volume of the internal vault cavity is approximately $50 \times 10^3$ nm$^3$, which is large enough to enclose an entire ribosomal protein. For comparison, vault particles are larger in mass and size than many icosahedral viruses and are about 1/10 the size of a typical *Staphylococcus* bacterium.

Vaults comprise three different proteins, designated MVP, VPARP and TEP1, and between one and three different untranslated RNA molecules, designated vRNAs. For example, the rat *Rattus norvegicus* has only one form of vRNA per vault, while humans have three forms of vRNA per vault. The most abundant protein, major vault protein (MVP), is a 95.8 kDa protein in *Rattus norvegicus* and a 99.3 kDa protein in humans which is present in 96 copies per vault and accounts for about 75% of the total protein mass of the vault particle. The two other proteins, the vault poly-ADP ribose polymerase, VPARP, a 193.3 kDa protein in humans, and the telomerase/vault associated protein 1, TEP1, a 292 kDa protein in *Rattus norvegicus* and a 290 kDa protein in humans, are each present in between about 2 and 16 copies per vault.

VPARP, is a poly ADP-ribosyl polymerase apparently unique to vaults. It includes a region of about 350 amino acids that shares 28% identity with the catalytic domain of poly ADP-ribosyl polymerase, PARP, a nuclear protein that catalyzes the formation of ADP-ribose polymers in response to DNA damage. VPARP catalyzes an NAD-dependent poly ADP-ribosylation reaction, and purified vaults have poly ADP-ribosylation activity that targets MVP, as well as VPARP itself.

According to one embodiment of the present invention, there is provided a vault-like particle useful for sequestering the one or more than one substance within the vault-like particle.

According to another embodiment of the present invention, there is provided a vault-like particle useful as a carrier molecule for delivering one or more than one substance to a living system, such as an organism, specific tissue or specific cell, or to an environmental medium.

In some aspects, vaccine compositions are provided herein for delivering an immunogenic peptide to a subject in a manner effective to induce an immune response against the peptide, wherein the compositions comprise a vault-like-particle associated with an immunogenic peptide or an immunogenic fragment or variant thereof. In some preferred aspects, the immunogenic peptide is the Chlamydial major outer membrane protein (MOMP).

In further aspects, the immunogenic peptide is another Chlamydial peptide capable of producing protective immune responses, such as but not limited to a peptide described in Murthy et al., *Infect. Immun.*, 75(2):666-76 (2007); He et al., *Immunology*, 122(1):28-37 (2007); or Weinreich et al., *Journal of Infectious Diseases*, 196(10):1546-52 (2007), all of which are herein incorporated by reference. Peptides can be screened for immunogenicity by expressing the peptides in a vault as described herein and testing for anti-MVP antibodies or utilizing other indicators of immunity known in the art.

Immunogenic peptides provided herein can comprise, consist essentially of and/or consist of any fragment of contiguous amino acids of MOMP from any biovar and/or serotype of *C. trachomatis*, including, for example, fragments of 5, 10, 15, 20, 25, 30, 35, 40, 45, 50, 75, 100, 150, 200, 250, 300, 350 or more contiguous amino acids up to and including full length MOMP.

Variants of immunogenic peptides provided herein include homologous proteins and fragments thereof from other strains of *Chlamydia* and/or other organisms. A homologous protein is a polypeptide or fragment thereof that shares significant homology with a reference polypeptide. Homologous proteins include proteins and fragments thereof having at least 75%, 80%, 85%, 90%, 95%, 98% and/or 100% homology with a reference amino acid sequence. Methods for identifying homologues of the polypeptides described herein in *Chlamydia* and/or other organisms are known in the art.

In some preferred aspects, vaccine compositions provided herein are useful for delivering the immunogenic peptide to a mucosal surface in a manner effective to induce a cell-mediated immune response and/or an antibody immune response against the Chlamydial peptide. In further aspects, vaccine compositions provided herein are suitable for administration to the nasal mucosa and are capable of inducing a cell-mediated immune response and/or an antibody immune response at vaginal surfaces and/or within the genital tract upon intransal administration.

The terms "protective immunity" means that the subject mounts an active immune response to the immunogenic composition and/or that the subject has been provided with passive immunity, such that upon subsequent exposure or a challenge, the subject is able to resist and/or overcome infection and/or disease. Thus, a protective immune response will preferably decrease the incidence of morbidity and/or mortality from subsequent exposure to Chlamydial pathogens.

An "active immune response" is mounted by the host after exposure to immunogens by infection or by vaccination. In contrast, "passive immunity" is acquired through the transfer of preformed substances (e.g., antibodies, transfer factors, thymic grafts, interleukin-2, and the like) from an actively immunized host to a non-immune host.

A "cell-mediated immune response" refers to a helper T cell response which involves the production of interferon-gamma (IFN-γ), leading to cell-mediated immunity.

An "antibody immune response" refers to a helper T cell response which involves the release of interleukin 4 (IL-4), leading to humoral immunity.

A "subject" referred to herein can be any animal susceptible to infection by a Chlamydial species, including a mammal (e.g., a laboratory animal such as a rat, mouse, guinea pig, rabbit, primates, etc.), a farm or commercial animal (e.g., a cow, horse, goat, donkey, sheep, etc.), a domestic animal (e.g., cat, dog, ferret, etc.), an avian species, or a human.

Without being limited to a particular theory, it is believed that incorporating an immunogenic peptide or fragment thereof in a vault-like-particle enhances the immunogenicity of the peptide, e.g., by protecting immunogenic peptides from environmental factors and/or enhancing cell-mediated immune responses. For example, conformational integrity is essential for inducing protective immunogenicity using MOMP and the packaging of MOMP within the vault core acts to preserve MOMP's native conformation, e.g. by shielding it from degradative enzymes and/or other destabilizing factors. In further aspects, the size and/or shape of vault-like particles provided herein is similar to microbial pathogens and allows the particles to be readily internalized by antigen-presenting cells (APCs), including but not limited to, dendritic cells, macrophages and/or B-cells. The vault particles thus facilitate the processing and presentation of immunogenic peptides on cell surface MHC molecules required for induction of a cell-mediated immune response.

In some preferred aspects, administering a vaccine provided herein induces both cell-mediated and antibody-based immune responses against Chlamydial antigens in mucosal tissues. In further aspects, administering a vaccine provided herein to the nasal mucosa induces protective immunity against *Chlamydia* genital infection at vaginal surfaces and/or within the genital tract. In some preferred aspects, intranasal administration of vaccines provided herein induces protective immunity against *Chlamydia* genital infection in the absence of an adjuvant and/or a live microbial vector.

In some aspects, vaccines provided herein induce protective immunity by reducing the magnitude, extent and/or duration of mucosal infection upon intravaginal challenge with Chlamydial antigens.

In further aspects, vaccines provided herein reduce inflammation in the genital tract associated with subsequent intravaginal challenge with Chlamydial antigens. Without being limited to a particular theory, it is believed that repeated exposures to Chlamydial antigens results in increasing inflammatory responses which are not necessary for protection against Chlamydial infection but are associated with reproductive dysfunction and other complications. Advantageously, vaccines described herein reduce immune-related pathology and morbidity following Chlamydial STI's by inducing protective immunity and/or reducing inflammation upon re-exposure to antigens.

In some aspects, nasal immunization with a vaccine provided herein induces protective cellular immunity and eradicates bacterial vaginal burden to a similar extent as intranasal infection with live chlamydiae in the absence of added adjuvants and/or a live microbial vector.

According to another embodiment of the present invention, there is provided a method of using vaults as carrier molecules to deliver one or more than one substance to an organism, or to a specific tissue or specific cells. The method comprises administering vaults comprising the substance to the organism, tissue or cells.

According to another embodiment of the present invention, there is provided a method of delivering one or more than one substance to an organism, or to a specific tissue or specific cells, or to an environmental medium. The method comprises providing vault-like particles comprising the substance, and administering the vault-like particles comprising the substance to the organism, tissue or cells, or to the environmental medium.

According to another embodiment of the present invention, there is provided a method of delivering vault-like particles to a specific tissue or specific cells, or to an environmental medium. The method comprises providing vault-like particles having a receptor-binding domain on the surface of the vault-like particles, and administering the vault-like particles to the tissue or cells, or to the environmental medium.

In some aspects, vault-like particles used as carriers for immunogenic peptides further comprise a targeting moiety which binds preferentially to a particular molecule, cell type, tissue, organ, or the like. For example, in some preferred aspects, the targeting moiety comprises an Fc binding domain capable of binding immunoglobulins. Without being limited to a particular theory, it is believed that Fc receptors play an important role in immune responses to infectious pathogens, such as C. trachomatis, and that binding of Fc receptors by an Ig Fc domain stimulates a variety of effector functions, including but not limited to, immune complex internalization, phagocytosis, and T-cell activation. Advantageously, vault-like-particles provided herein which comprise an Fc binding domain have an enhanced ability to induce T-cell responses and stimulate protective immunity against C. trachomatis infection.

In some aspects, methods are provided herein for treating or preventing infection with C. trachomatis, the methods comprising administering an immunogenic Chlamydial peptide or an immunogenic fragment or variant thereof to a subject in association with a vault-like-particle carrier.

In some aspects, methods are provided herein for treating or preventing a disease or condition caused by Chlamydia trachomatis infection. For example, in various aspects, methods are provided herein to reduce the degree and/or incidence of hydrosalpinx, oviduct dilatation, and/or cellular infiltration associated with chlamydial infection.

In further aspects, methods are provided herein for immunizing a subject against infection with C. trachomatis, the methods comprising administering an immunogenic Chlamydial peptide or an immunogenic fragment or variant thereof to a subject in association with a vault-like-particle carrier.

In further aspects, methods are provided herein for reducing the likelihood of infertility in the subject due to Chlamydial infection, the methods comprising administering an immunogenic Chlamydial peptide or an immunogenic fragment or variant thereof to a subject in association with a vault-like-particle carrier.

In further aspects, methods are provided herein for eliciting an immune response in a subject against C. trachomatis, the methods comprising administering an immunogenic Chlamydial peptide or an immunogenic fragment or variant thereof to a subject in association with a vault-like-particle carrier.

According to another embodiment of the present invention, there is provided a method of preventing damage by one or more than one substance to an organism, or to a specific tissue or specific cells, or to an environmental medium, by sequestering the one or more than one substance within a vault-like particle. The method comprises providing vault-like particles comprising one or more than one substance-binding domain within the vault-like particle, administering the vault-like particles to the organism, tissue or cells, or to the environmental medium, and allowing the vault-like particles to sequester the one or more than one substance within the vault-like particles.

Advantageously, both vaults and vault-like particles are resistant to degradation, such as intracellular degradation or environmental degradation, and therefore, can be used to deliver substances to or to remove substances from both living and non-living systems. The embodiments of the present invention will now be disclosed in greater detail.

In some aspects, vault-like-particles and vaccine compositions comprising such particles can be modified and/or administered with additional agents to increase antigenicity. Methods of increasing the antigenicity of a protein or peptide are well known in the art and include, e.g., coupling the antigen to a heterologous protein (such as globulin or β-galactosidase) or administering the protein or peptide with one or more adjuvants, such as but not limited to, an immunostimulatory cytokine and commercial adjuvant preparations such as SYNTEX adjuvant formulation 1 (SAF-1).

In further aspects, vault-like-particles and vaccine compositions provided herein are intended for administration without added adjuvants and/or live vectors.

In additional aspects, kits are provided herein comprising compositions and particles described herein and instructions for immunizing a subject against and/or treating a subject for a Chlamydial infection by administering a vaccine composition or vault-like-particle described herein to the subject. The kits can optionally comprise one or more containers and/or receptacles to hold the compositions and/or particles along with one or more optional reagents (e.g., antibodies, antigens, nucleic acids, adjuvants, and/or other immunodulating agents), buffers, diluents and/or other solutions.

As used in this disclosure, "MVP," "VPARP" and "TEP1" means the full naturally occurring polypeptide sequence. "vRNA" means the full naturally occurring polynucleotide sequence. As will be appreciated by one of ordinary skill in the art with reference to this disclosure, the actual sequence of any of MVP, VPARP, TEP1 and vRNAs can be from any species suitable for the purposes disclosed in this disclosure, even though reference or examples are made to sequences from specific species. For example, when delivering substances to human organs or tissues, it is preferred to use human vaults or vault-like particles comprising human sequences for MVP, VPARP, TEP1 and vRNAs. Further, as will be appreciated by one of ordinary skill in the art with reference to this disclosure, there are some intraspecies variations in the sequences of MVP, VPARP, TEP1 and vRNAs that are not relevant to the purposes of the present invention. Therefore, references to MVP, VPARP, TEP1 and vRNAs are intended to include such intraspecies variants.

As used in this disclosure, the term "vault" or "vault particle," as compared to the term "vault-like particle" defined below, refers to a naturally occurring macro-molecular structure having MVP, VPARP, TEP1 and one or more than one vRNA, whether purified from natural sources or generated through recombinant technology.

As used in this disclosure, the term "vault-like particle" refers to a macro-molecular structure comprising any of the following:
1) MVP without VPARP, TEP1 and vRNA;
2) MVP and either VPARP or a portion of VPARP, without TEP1 and vRNA;
3) MVP and TEP1 or a portion of TEP1 with or without the one or more than one vRNA, and without VPARP;
4) MVP without VPARP, TEP1 and vRNA, where the MVP is modified to attract a specific substance within the vault-like particle, or modified to attract the vault-like particle to a specific tissue, cell type or environmental medium, or modified both to attract a specific substance within the vault-like particle and to attract the vault particle to a specific tissue, cell type or environmental medium; and
5) MVP, and either VPARP or a portion of VPARP, or TEP1 or a portion of TEP1 with or without the one or more than one vRNA, or with both VPARP or a portion of VPARP, and TEP1, with or without the one or more than one vRNA, where one or more than one of the MVP, VPARP or portion of VPARP and TEP1 is modified to attract a specific substance within the vault-like particle, or modified to attract the vault particle to a specific tissue, cell type or environmental medium, or modified both to attract a specific substance within the vault-like particle and to attract the vault particle to a specific tissue, cell type or environmental medium.

As used in this disclosure, the term "modified" and variations of the term, such as "modification," means one or more than one change to the naturally occurring sequence of MVP, VPARP or TEP1 selected from the group consisting of addition of a polypeptide sequence to the C-terminal, addition of a polypeptide sequence to the N-terminal, deletion of between about 1 and 100 amino acid residues from the C-terminal, deletion of between about 1 and 100 amino acid residues from the N-terminal, substitution of one or more than one amino acid residue that does not change the function of the polypeptide, as will be appreciated by one of ordinary skill in the art with reference to this disclosure, such as for example, an alanine to glycine substitution, and a combination of the preceding.

As used in this disclosure, the term "human" means "*Homo sapiens.*"

As used in this disclosure, the terms "organism," "tissue" and "cell" include naturally occurring organisms, tissues and cells, genetically modified organisms, tissues and cells, and pathological tissues and cells, such as tumor cell lines in vitro and tumors in vivo.

As used in this disclosure, the term "environmental medium" means a non-living composition, composite, material, or mixture.

As used in this disclosure, the term "administering" includes any suitable route of administration, as will be appreciated by one of ordinary skill in the art with reference to this disclosure, including direct injection into a solid organ, direct injection into a cell mass such as a tumor, inhalation, intraperitoneal injection, intravenous injection, topical application on a mucous membrane, or application to or dispersion within an environmental medium, and a combination of the preceding. In one embodiment, the dosage of vaults or vault-like particles, with or without one or more than one substance enclosed within the vaults or vault-like particles, is between about 0.1 and 10,000 micrograms per kilogram of body weight or environmental medium. In another embodiment, the dosage of vaults or vault-like particles, with or without one or more than one substance enclosed within the vaults or vault-like particles, is between about 1 and 1,000 micrograms per kilogram of body weight or environmental medium. In another embodiment, the dosage of vaults or vault-like particles, with or without one or more than one substance enclosed within the vaults or vault-like particles, is between about 10 and 1,000 micrograms per kilogram of body weight or environmental medium. For intravenous injection and intraperitoneal injection, the dosage is preferably administered in a final volume of between about 0.1 and 10 ml. For inhalation the dosage is preferably administered in a final volume of between about 0.01 and 1 ml. As will be appreciated by one of ordinary skill in the art with reference to this disclosure, the dose can be repeated a one or more than one of times as needed using the same parameters to effect the purposes disclosed in this disclosure.

As used in this disclosure, "MS2" means the Enterobacteriophage MS2 coat protein, which is an RNA-binding protein that specifically binds a 21-nt RNA stem-loop with high affinity.

As used in this disclosure, the term "comprise" and variations of the term, such as "comprising" and "comprises," are not intended to exclude other additives, components, integers or steps.

In one embodiment, the present invention is a method of using naturally occurring vaults as carrier molecules to deliver one or more than one substance to an organism, or to a specific tissue or specific cells, or to an environmental medium. The method comprises, first, providing vaults. In one embodiment, the vaults are purified from natural sources, such as mammalian liver or spleen tissue, using methods known to those with skill in the art, such as for example tissue homogenization, differential centrifugation, discontinuous sucrose gradient fractionation and cesium chloride gradient fractionation. In another embodiment, the vaults are made using recombinant technology. Next, the one or more than one substance is incorporated into the provided vaults. In a preferred embodiment, incorporation is accomplished by incubating the vaults with the one or more than one substance at an appropriate temperature and for an appropriate time, as will be appreciated by one of ordinary skill in the art with reference to this disclosure. The vaults containing the one or more than one substance are then purified, such as for example sucrose gradient fractionation, as will be appreciated by one of ordinary skill in the art with reference to this disclosure. In a preferred embodiment, the one or more than one substance is selected from the group consisting of an enzyme, a pharmaceutical agent, a plasmid, a polynucleotide, a polypeptide, a sensor and a combination of the preceding. Next, the vaults comprising the one or more than one substance are administered to an organism, to a specific tissue, to specific cells, or to an environmental medium. Administration is accomplished using any suitable route, as will be appreciated by one of ordinary skill in the art with reference to this disclosure.

According to another embodiment of the present invention, there is provided a vault-like particle useful as a carrier molecule for delivering one or more than one substance to an organism, to a specific tissue, to specific cells, or to an environmental medium, or useful for preventing damage by one or more than one substance to an organism, to a specific tissue, to specific cells, or to an environmental medium, by sequestering the one or more than one substance within a vault-like particle. The vault-like particle comprises MVP or modified MVP, and can further comprise VPARP or modified VPARP, a portion of VPARP or a modified portion of VPARP, and TEP1 or modified TEP1, a portion of TEP1 or a modified portion of TEP1 with or without the one or more than one vRNA. In a preferred embodiment, the modifications are designed to attract a specific substance within the vault-like particle, to attract the vault-like particle to a specific tissue or cell type, or both to attract a specific substance within the vault-like particle and to attract the vault particle to a specific tissue or cell type.

In one embodiment, the MVP is human MVP, SEQ ID NO:1, GenBank accession number CAA56256, encoded by the cDNA, SEQ ID NO:2, GenBank accession number X79882. In another embodiment, the VPARP is human VPARP, SEQ ID NO:3, GenBank accession number AAD47250, encoded by the cDNA, SEQ ID NO:4, GeWank accession number AF158255. In another embodiment, the TEP1 is human TEP1, SEQ ID NO:5, GenBank accession number AAC51107, encoded by the cDNA, SEQ ID NO:6, GenBank accession number U86136. In another embodiment, the vRNA is human vRNA, SEQ ID NO:7, GenBank accession number AF045143, SEQ ID NO:8, GenBank accession number AF045144, or SEQ ID NO:9, GenBank accession number AF045145, or a combination of the preceding.

In one embodiment, the MVP is *Rattus norvegicus* MVP, SEQ ID NO:10, GenBank accession number AAC52161, encoded by the cDNA, SEQ ID NO:11, GenBank accession number U09870. In another embodiment, the TEP1 is *Rattus norvegicus* TEP1, SEQ ID NO:12, GenBank accession number AAB51690, encoded by the cDNA, SEQ ID NO:13, GenBank accession number U89282. In another embodiment, the vRNA is *Rattus norvegicus* vRNA, SEQ ID NO:14, GenBank accession number Z1171. As can be seen, *Rattus norvegicus* MVP and human MVP share over 90% homology.

The following disclosure of vault protein modifications reference specific examples using specific human and *Rattus norvegicus* MVP, VPARP and TEP1 sequences. However, as will be appreciated by one of ordinary skill in the art with reference to this disclosure, corresponding modifications can be made using other sequences of these species and can be made using sequences from other species as appropriate for the disclosed purposes.

According to one embodiment of the present invention, there is provided a vault-like particle comprising, consisting essentially of, or consisting of modified MVP. In a preferred embodiment, the modification comprises adding an amino acid sequence to the N-terminal of the MVP which results in one or more than one substance-binding domain within the vault-like particle. When each copy of the MVP is modified in this manner, one or more than one of the substance-binding domains, such as 96 substance-binding domains, is present in each vault-like particle, however, vault-like particles can also be assembled from a mixture of MVP with the N-terminal modified and MVP without the N-terminal modified, to create vault-like particle with less than 96 substance-binding domains in the vault-like particle, and the added amino acid terminal sequences can be polymerized as will be appreciated by one of ordinary skill in the art with reference to this disclosure to create more than 96 substance-binding domains in the vault-like particle.

In some aspects, vault-like particles are provided herein comprising, consisting essentially of, or consisting of modified MVP, where the modification comprises adding an amino acid sequence to the N-terminal of the MVP which results in one or more than one immunogenic peptide, or an immunogenic fragment or variant thereof, within the vault-like particle. In some preferred aspects, the immunogenic peptide is Chlamydial MOMP.

In a preferred embodiment, there is provided a vault-like particle comprising, consisting essentially of, or consisting of an MVP modified by adding a peptide to the N-terminal to create a one or more than one of heavy metal binding domains. In a preferred embodiment, the heavy metal binding domains bind a heavy metal selected from the group consisting of cadmium, copper, gold and mercury. In a preferred embodiment, the peptide added to the N-terminal is a cysteine-rich peptide (CP), such as for example, SEQ ID NO:15, the MVP is human MVP, SEQ ID NO:1, and the modification results in CP-MVP, SEQ ID NO:16, encoded by the cDNA, SEQ ID NO:17. In another preferred embodiment, the cysteine-rich peptide is SEQ ID NO:15, the MVP is *Rattus norvegicus* MVP, SEQ ID NO:10, and the modification results in CP-MVP, SEQ ID NO:18, encoded by the cDNA, SEQ ID NO:19. These embodiments are particularly useful because vault-like particles consisting of CP-MVP, SEQ ID NO:16 or SEQ ID NO:18, are stable without the presence of other vault proteins.

In another embodiment, there is provided a vault-like particle comprising, consisting essentially of, or consisting of an MVP modified by adding a peptide to the N-terminal to create one or more than one polynucleotide-binding domain. In a preferred embodiment, the peptide is a non-specific polynucleotide-binding peptide, such as for example, HisT7, SEQ ID NO:20, encoded by the cDNA, SEQ ID NO:21, or a polylysine such as SEQ ID NO:22, encoded by the cDNA, SEQ ID NO:23, the MVP is human MVP, SEQ ID NO:1, and the modification results in HisT7-MVP, SEQ ID NO:24, encoded by the cDNA, SEQ ID NO:25, or in polylysine-MVP, SEQ ID NO:26, encoded by the cDNA, SEQ ID NO:27, respectfully. In another preferred embodiment, the peptide is a non-specific polynucleotide-binding peptide, such as for example, HisT7, SEQ ID NO:20, encoded by the cDNA, SEQ ID NO:21, or a polylysine such as SEQ ID NO:22, encoded by the cDNA, SEQ ID NO:23, the MVP is *Rattus norvegicus* MVP, SEQ ID NO:10, and the modification results in HisT7-MVP, SEQ ID NO:28, encoded by the cDNA, SEQ ID NO:29, or in polylysine-MVP, SEQ ID NO:30, encoded by the cDNA, SEQ ID NO:31, respectfully. HisT7-MVP, SEQ ID NO:24 and SEQ ID NO:28, are examples of modified MVP that can also be used to bind specific antibodies within the vault-like particle, in these cases, the T7 monoclonal antibody, but corresponding modifications can be made to bind other specific antibodies, as will be appreciated by one of ordinary skill in the art with reference to this disclosure. In another preferred embodiment, the peptide is a specific DNA binding peptide, such as for example, GAL4, SEQ ID NO:32, encoded by the cDNA, SEQ ID NO:33, the MVP is human MVP, SEQ ID NO:1, and the modification results in GAL4-MVP, SEQ ID NO:34, encoded by the cDNA, SEQ ID NO:35. In another preferred embodiment, the peptide is a specific DNA binding peptide, such as for example, GAL4, SEQ ID NO:32, encoded by the cDNA, SEQ ID NO:33, the MVP is *Rattus norvegicus* MVP, SEQ ID NO:10, and the modification results in GAL4-MVP, SEQ ID NO:36, encoded by the cDNA, SEQ ID NO:37. In another preferred embodiment, the peptide is a specific RNA binding peptide, such as for example, MS2, SEQ ID NO:38, encoded by the cDNA, SEQ ID NO:39, the MVP is human MVP, SEQ ID NO:1, and the modification results in MS2-MVP, SEQ ID NO:40, encoded by the cDNA, SEQ ID NO:41. In another preferred embodiment, the peptide is an RNA binding peptide, such as for example, MS2, SEQ ID NO:38, encoded by the cDNA, SEQ ID NO:39, the MVP is *Rattus norvegicus* MVP, SEQ ID NO:10, and the modification results in MS2-MVP, SEQ ID NO:42, encoded by the cDNA, SEQ ID NO:43.

In another embodiment, there is provided a vault-like particle comprising, consisting essentially of, or consisting of an MVP modified by adding a peptide to the N-terminal to create a sensor in the vault-like particle. The sensor can be any suitable sensor, as will be appreciated by one of ordinary skill in the art with reference to this disclosure, such as for example, a chemical sensor such as a cyclic-AMP binding protein, an ionic sensor such as a calcium or potassium sensor, a microorganism sensor such an antibody specific for *E. coli*, an optical sensor such as a quantum dot, and a pH sensor such as green fluorescence protein. In a preferred embodiment, the sensor is a fluorescent protein, such as green fluorescent protein (GL), SEQ ID NO:44, encoded by the cDNA, SEQ ID NO:45, the MVP is human MVP, SEQ ID NO:1, and the modification results in GL-MVP, SEQ ID NO:46, encoded by the cDNA, SEQ ID NO:47. In another preferred embodiment, the sensor is a fluorescent protein, such as green fluorescent protein (GL), SEQ ID NO:44, encoded by the cDNA, SEQ ID NO:45, the MVP is *Rattus norvegicus* MVP, SEQ ID NO:10, and the modification results in GL-MVP, SEQ ID NO:48, encoded by the cDNA, SEQ ID NO:49.

In another embodiment, there is provided a vault-like particle comprising MVP or modified MVP, and further comprising VPARP or a portion of VPARP comprising at least about 150 consecutive residues of VPARP, and modified by adding a peptide to either the C-terminal or the N-terminal to create a one or more than one of substance-binding domains or a one or more than one of sensors within the vault-like particles having the same purposes as disclosed with reference to modified MVP in this disclosure. By way of example only, in one embodiment, the residues are from about residue 1562 to residue 1724 of human VPARP, SEQ ID NO:3. In another embodiment, the residues are from about residue 1473 to residue 1724 of human VPARP, SEQ ID NO:3. The substance-binding domains on the VPARP or portion of VPARP serve the same functions as disclosed in this disclosure with respect to N-terminal modifications of MVP. For example, in one embodiment, the vault-like particles comprise residues 1473-1724 of VPARP, SEQ ID NO:3, modified by adding CP, SEQ ID NO:15, to the N-terminal, to create (1473-1724)CP-VPARP, SEQ ID NO:50, encoded by the cDNA, SEQ ID NO:51. In another embodiment, the vault-like particles comprise VPARP, SEQ ID NO:3, modified by adding CP, SEQ ID NO:15, to the N-terminal, to create CP-VPARP, SEQ ID NO:52, encoded by the cDNA, SEQ ID NO:53. In one embodiment, the vault-like particles comprise residues 1473-1724 of VPARP, SEQ ID NO:3, modified by adding GAL4, SEQ ID NO:32, to the N-terminal, to create GAL4-(1473-1724)VPARP, SEQ ID NO:54, encoded by the cDNA, SEQ ID NO:55. In another embodiment, the vault-like particles comprise VPARP, SEQ ID NO:3, modified by adding GAL4, SEQ ID NO:32, to the N-terminal, to create GAL4-VPARP, SEQ ID NO:56, encoded by the cDNA, SEQ ID NO:57. In another embodiment, the vault-like particles comprise residues 1473-1724 of VPARP, SEQ ID NO:3, modified by adding GL, SEQ ID NO:44, to the N-terminal, to create GL-(1473-1724)VPARP, SEQ ID NO:58, encoded by the cDNA, SEQ ID NO:59. In another embodiment, the vault-like particles comprise VPARP, SEQ ID NO:3, modified by adding GL, SEQ ID NO:44, to the N-terminal, to create GL-VPARP, SEQ ID NO:60, encoded by the cDNA, SEQ ID NO:61. In another embodiment, the vault-like particles comprise residues 1473-1724 of VPARP, SEQ ID NO:3, modified by adding MS2, SEQ ID NO:38, to the N-terminal, to create MS2-(1473-1724)VPARP, SEQ ID NO:62, encoded by the cDNA, SEQ ID NO:63. In another embodiment, the vault-like particles comprise VPARP, SEQ ID NO:3, modified by adding MS2, SEQ ID NO:38, to the N-terminal, to create MS2-VPARP, SEQ ID NO:64, encoded by the cDNA, SEQ ID NO:65. In another embodiment, the vault-like particles comprise residues 1473-1724 of VPARP, SEQ ID NO:3, modified by adding a *Photinus pyralis* luciferase (LUC), SEQ ID NO:66 GenBank accession number P08659, encoded by the pGL3-Basic vector SEQ ID NO:67, GenBank accession number U47295 to the N-terminal, to create LUC-(1473-1724)VPARP, SEQ ID NO:68, encoded by the cDNA, SEQ ID NO:69.

In further aspects, vault-like particles are provided herein comprising MVP or modified MVP, and further comprising VPARP or a portion of VPARP comprising at least about 150 consecutive residues of VPARP, and modified by adding a peptide to either the C-terminal or the N-terminal to create a one or more than immunogenic peptides, or immunogenic fragments or variants thereof, within the vault-like particles. In some preferred aspects, the immunogenic peptide is Chlamydial MOMP.

In another embodiment, the vault-like particles comprise VPARP, SEQ ID NO:3, modified by adding LUC, SEQ ID NO:66, to the N-terminal, to create LUC-VPARP, SEQ ID NO:71, encoded by the cDNA, SEQ ID NO:72. Further, as will be appreciated by one of ordinary skill in the art with reference to this disclosure, the present invention also includes corresponding modifications to the C-terminal of VPARP or a portion of VPARP, and serve the same function. In a preferred embodiment, the substance binding domain binds the enzyme adenosine deaminase.

According to one embodiment of the present invention, there is provided a vault-like particle comprising, consisting essentially of, or consisting of MVP modified by adding an amino acid sequence to the C-terminal of the MVP which results in one or more than one receptor-binding domain, such as a protein targeting domain, on the surface of the vault-like particle. When each copy of the MVP is modified in this manner, one or more than one of the receptor-binding domains, such as 96 receptor-binding domains, is present on each vault-like particle, however, vault-like particles can also be assembled from a mixture of MVP with the C-terminal modified and MVP without the C-terminal modified, to create vault-like particle with less than 96 receptor-binding domains on the vault-like particle.

In some aspects, vault-like particles are provided herein comprising, consisting essentially of, or consisting of MVP modified by adding an amino acid sequence to the C-terminal of the MVP which results in one or more than one immunogenic peptide, or an immunogenic fragment or variant thereof, on the surface of the vault-like particle. In some preferred aspects, the immunogenic peptide is Chlamydial MOMP.

In a preferred embodiment, there is provided a vault-like particle comprising, consisting essentially of, or consisting of an MVP modified by adding a peptide to the C-terminal to create a one or more than one of eukaryotic cell receptor-binding domains on the exterior of the vault-like particles. In a preferred embodiment, the eukaryotic cell receptor-binding domain is generally non-specific. For example, in one embodiment, the peptide is Antennapedia (ANT), SEQ ID NO:72, encoded by the cDNA, SEQ ID NO:73, the MVP is human MVP, SEQ ID NO:1, and the modification results in MVP-ANT, SEQ ID NO:74, encoded by the cDNA, SEQ ID NO:75. In another embodiment, the peptide is ANT, SEQ ID NO:72, encoded by the cDNA, SEQ ID NO:73, the MVP is *Rattus norvegicus* MVP, SEQ ID NO:10, and the modification results in MVP-ANT, SEQ ID NO:76, encoded by the cDNA, SEQ ID NO:77. In another embodiment, the peptide is HIV-Tat (TAT), SEQ ID NO:78, encoded by the cDNA, SEQ ID NO:79, the MVP is human MVP, SEQ ID NO:1, and the modification results in MVP-TAT, SEQ ID NO:80, encoded by the cDNA, SEQ ID NO:81. In another embodiment, the peptide is TAT, SEQ ID NO:78, encoded by the cDNA, SEQ ID NO:79, the MVP is *Rattus norvegicus* MVP, SEQ ID NO:10, and the modification results in MVP-TAT, SEQ ID NO:82, encoded by the cDNA, SEQ ID NO:83. In another embodiment, the eukaryotic cell receptor-binding domain is specific to a certain type of eukaryotic cell receptor, such as for example a carcinoembryonic antigen receptor, a protein found on the surface of about 50% of all human tumors, or an epidermal growth factor (EGF) receptor. For example, in one embodiment, the peptide is anti-CEA scFv diabody (αCEA), SEQ ID NO:84, encoded by the cDNA, SEQ ID NO:85, the MVP is human MVP, SEQ ID NO:1, and the modification results in MVP-αCEA, SEQ ID NO:86, encoded by the cDNA, SEQ ID NO:87. In another embodiment, the peptide is UCEA, SEQ ID NO:84, encoded by the cDNA, SEQ ID NO:85, the MVP is *Rattus norvegicus* MVP, SEQ ID NO:10, and the modification results in MVP-αCEA, SEQ ID NO:88, encoded by the cDNA, SEQ ID NO:89. In another embodiment, the peptide is EGF, SEQ ID NO:90, encoded by the cDNA, SEQ ID NO:91, the MVP is human MVP, SEQ ID NO:1, and the modification results in MVP-EGF, SEQ ID NO:92, encoded by the cDNA, SEQ ID NO:93. In another embodiment, the peptide is EGF, SEQ ID NO:90, encoded by the cDNA, SEQ ID NO:91, the MVP is *Rattus norvegicus* MVP, SEQ ID NO:10, and the modification results in MVP-EGF, SEQ ID NO:94, encoded by the cDNA, SEQ ID NO:95.

According to one embodiment of the present invention, there is provided a vault-like particle comprising, consisting essentially of, or consisting of MVP modified by adding an amino acid sequence to the N-terminal and also modified by adding an amino acid sequence to the C-terminal. The modification of the N-terminal and the modification of the C-terminal can be any modification as disclosed in this disclosure, for the same purposes as disclosed in this disclosure. For example, the modification of the N-terminal can result in a substance-binding domain, such as for example a heavy metal binding domain or a polynucleotide binding domain, or can result in a sensor within the vault-like particle. The modification of the C-terminal can result in one or more than one receptor-binding domain on the surface of the vault-like particle. By way of example only, in one embodiment, the vault-like particle comprises, consists essentially of, or consists of MVP modified by adding GAL4, SEQ ID NO:32, to the N-terminal of human MVP, SEQ ID NO:1, and ANT, SEQ ID NO:72 to the C-terminal of human MVP, SEQ ID NO:1, to create GAL4-MVP-ANT, SEQ ID NO:96, encoded by the cDNA, SEQ ID NO:97. In another embodiment, the vault-like particle comprises, consists essentially of, or consists of MVP modified by adding GAL4, SEQ ID NO:32, to the N-terminal of *Rattus norvegicus* MVP, SEQ ID NO:10, and ANT, SEQ ID NO:72 to the C-terminal of *Rattus norvegicus* MVP, SEQ ID NO:10, to create GAL4-MVP-ANT, SEQ ID NO:98, encoded by the cDNA, SEQ ID NO:99. In another embodiment, the vault-like particle comprises, consists essentially of, or consists of MVP modified by adding GAL4, SEQ ID NO:32, to the N-terminal of human MVP, SEQ ID NO:1, and αCEA, SEQ ID NO:84 to the C-terminal of human MVP, SEQ ID NO:1, to create GAL4-MVP-αCEA, SEQ ID NO:100, encoded by the cDNA, SEQ ID NO:101. In another embodiment, the vault-like particle comprises, consists essentially of, or consists of MVP modified by adding GAL4, SEQ ID NO:32, to the N-terminal of *Rattus norvegicus* MVP, SEQ ID NO:10, and αCEA, SEQ ID NO:84 to the C-terminal of *Rattus norvegicus* MVP, SEQ ID NO:10, to create GAL4-MVP-αCEA, SEQ ID NO:102, encoded by the cDNA, SEQ ID NO:103. In another embodiment, the vault-like particle comprises, consists essentially of, or consists of MVP modified by adding GAL4, SEQ ID NO:32, to the N-terminal of human MVP, SEQ ID NO:1, and EGF, SEQ ID NO:90 to the C-terminal of human MVP, SEQ ID NO:1, to create GAL4-MVP-EGF, SEQ ID NO:104, encoded by the cDNA, SEQ ID NO:105. In another embodiment, the vault-like particle comprises, consists essentially of, or consists of MVP modified by adding GAL4, SEQ ID NO:32, to the N-terminal of *Rattus norvegicus* MVP, SEQ ID NO:10, and EGF, SEQ ID NO:90 to the C-terminal of *Rattus norvegicus* MVP, SEQ ID NO:10, to create GAL4-MVP-EGF, SEQ ID NO:106, encoded by the cDNA, SEQ ID NO:107. In another embodiment, the vault-like particle comprises, consists essentially of, or consists of MVP modified by adding GAL4, SEQ ID NO:32, to the N-terminal of human MVP, SEQ ID NO:1, and TAT, SEQ ID NO:78 to the C-terminal of human MVP, SEQ ID NO:1, to create GAL4-MVP-TAT, SEQ ID NO:108, encoded by the cDNA, SEQ ID NO:109. In another embodiment, the vault-like particle comprises, consists essentially of, or consists of MVP modified by adding GAL4, SEQ ID NO:32, to the N-terminal of *Rattus norvegicus* MVP, SEQ ID NO:1, and TAT, SEQ ID NO:78 to the C-terminal of *Rattus norvegicus* MVP, SEQ ID NO:10, to create GAL4-MVP-TAT, SEQ ID NO:110, encoded by the cDNA, SEQ ID NO:111. In one embodiment, the vault-like particle comprises, consists essentially of, or consists of MVP modified by adding MS2, SEQ ID NO:38, to the N-terminal of human MVP, SEQ ID NO:1, and ANT, SEQ ID NO:72 to the C-terminal of human MVP, SEQ ID NO:1, to create MS2-MVP-ANT, SEQ ID NO:112, encoded by the cDNA, SEQ ID NO:113. In another embodiment, the vault-like particle comprises, consists essentially of, or consists of MVP modified by adding MS2, SEQ ID NO:38, to the N-terminal of *Rattus norvegicus* MVP, SEQ ID NO:10, and ANT, SEQ ID NO:72 to the C-terminal of *Rattus norvegicus* MVP, SEQ ID NO:10, to create MS2-MVP-ANT, SEQ ID NO:114, encoded by the cDNA, SEQ ID NO:115. In another embodiment, the vault-like particle comprises, consists essentially of, or consists of MVP modified by adding MS2, SEQ ID NO:38, to the N-terminal of human MVP, SEQ ID NO:1, and αCEA, SEQ ID NO:84 to the C-terminal of human MVP, SEQ ID NO:1, to create MS2-MVP-αCEA, SEQ ID NO:116, encoded by the cDNA, SEQ ID NO:117. In another embodiment, the vault-like particle comprises, consists essentially of, or consists of MVP modified by adding MS2, SEQ ID NO:38, to the N-terminal of *Rattus norvegicus* MVP, SEQ ID NO:10, and αCEA, SEQ ID NO:84 to the C-terminal of *Rattus norvegicus* MVP, SEQ ID NO:10, to create MS2-MVP-αCEA, SEQ ID NO:118, encoded by the cDNA, SEQ ID NO:119. In another embodiment, the vault-like particle comprises, consists essentially of, or consists of MVP modified by adding MS2, SEQ ID NO:38, to the N-terminal of human MVP, SEQ ID NO:1, and EGF, SEQ ID NO:90 to the C-terminal of human MVP, SEQ ID NO:1, to create MS2-MVP-EGF, SEQ ID NO:120, encoded by the cDNA, SEQ ID NO:121. In another embodiment, the vault-like particle comprises, consists essentially of, or consists of MVP modified by adding MS2, SEQ ID NO:38, to the N-terminal of *Rattus norvegicus* MVP, SEQ ID NO:10, and EGF, SEQ ID NO:90 to the C-terminal of *Rattus norvegicus* MVP, SEQ ID NO:10, to create MS2-MVP-EGF, SEQ ID NO:122, encoded by the cDNA, SEQ ID NO:123. In another embodiment, the vault-like particle comprises, consists essentially of, or consists of MVP modified by adding MS2, SEQ ID NO:38, to the N-terminal of human MVP, SEQ ID NO:1, and TAT, SEQ ID NO:78 to the C-terminal of human MVP, SEQ ID NO:1, to create MS2-MVP-TAT, SEQ ID NO:124, encoded by the cDNA, SEQ ID NO:125.

In further aspects, vault-like particles are provided herein comprising, consisting essentially of, or consisting of MVP modified by adding an amino acid sequence to the N-terminal and also modified by adding an amino acid sequence to the C-terminal. In some preferred aspects, the amino acid sequence added to the N-terminal and/or the amino acid added to the C-terminal is an immunogenic peptide, or an immunogenic fragment or variant thereof. In some preferred aspects, the immunogenic peptide is Chlamydial MOMP.

In another embodiment, the vault-like particle comprises, consists essentially of, or consists of MVP modified by adding MS2, SEQ ID NO:38, to the N-terminal of *Rattus norvegicus* MVP, SEQ ID NO:1, and TAT, SEQ ID NO:78 to the C-terminal of *Rattus norvegicus* MVP, SEQ ID NO:10, to create MS2-MVP-TAT, SEQ ID NO:126, encoded by the cDNA, SEQ ID NO:127. In one embodiment, the vault-like particle comprises, consists essentially of, or consists of MVP modified by adding polylysine, SEQ ID NO:22, to the N-terminal of human MVP, SEQ ID NO:1, and ANT, SEQ ID NO:72 to the C-terminal of human MVP, SEQ ID NO:1, to create polylysine-MVP-ANT, SEQ ID NO:128, encoded by the cDNA, SEQ ID NO:129. In another embodiment, the vault-like particle comprises, consists essentially of, or consists of MVP modified by adding polylysine, SEQ ID NO:22, to the N-terminal of *Rattus norvegicus* MVP, SEQ ID NO:10, and ANT, SEQ ID NO:72 to the C-terminal of a *Rattus norvegicus* MVP, SEQ ID NO:10, to create polylysine-MVP-ANT, SEQ ID NO:130, encoded by the cDNA, SEQ ID NO:131. In another embodiment, the vault-like particle comprises, consists essentially of, or consists of MVP modified by adding polylysine, SEQ ID NO:22, to the N-terminal of human MVP, SEQ ID NO:1, and αCEA, SEQ ID NO:84 to the C-terminal of human MVP, SEQ ID NO:1, to create polylysine-MVP-αCEA, SEQ ID NO:132, encoded by the cDNA, SEQ ID NO:133. In another embodiment, the vault-like particle comprises, consists essentially of, or consists of MVP modified by adding polylysine, SEQ ID NO:22, to the N-terminal of *Rattus norvegicus* MVP, SEQ ID NO:10, and αCEA, SEQ ID NO:84 to the C-terminal of *Rattus norvegicus* MVP, SEQ ID NO:10, to create polylysine-MVP-αCEA, SEQ ID NO:134, encoded by the cDNA, SEQ ID NO:135.

In another embodiment, the vault-like particle comprises, consists essentially of, or consists of MVP modified by adding polylysine, SEQ ID NO:22, to the N-terminal of human MVP, SEQ ID NO:1, and EGF, SEQ ID NO:90 to the C-terminal of human MVP, SEQ ID NO:1, to create polylysine-MVP-EGF, SEQ ID NO:136, encoded by the cDNA, SEQ ID NO:137.

In another embodiment, the vault-like particle comprises, consists essentially of, or consists of MVP modified by adding polylysine, SEQ ID NO:22, to the N-terminal of *Rattus norvegicus* MVP, SEQ ID NO:10, and EGF, SEQ ID NO:90 to the C-terminal of *Rattus norvegicus* MVP, SEQ ID NO:10, to create polylysine-MVP-EGF, SEQ ID NO:138, encoded by the cDNA, SEQ ID NO:139. In another embodiment, the vault-like particle comprises, consists essentially of, or consists of MVP modified by adding polylysine, SEQ ID NO:22, to the N-terminal of human MVP, SEQ ID NO:1, and TAT, SEQ ID NO:78 to the C-terminal of human MVP, SEQ ID NO:1, to create polylysine-MVP-TAT, SEQ ID NO:140, encoded by the cDNA, SEQ ID NO:141. In another embodiment, the vault-like particle comprises, consists essentially of, or consists of MVP modified by adding polylysine, SEQ ID NO:22, to the N-terminal of *Rattus norvegicus* MVP, SEQ ID NO:1, and TAT, SEQ ID NO:78 to the C-terminal of *Rattus norvegicus* MVP, SEQ ID NO:10, to create polylysine-MVP-TAT, SEQ ID NO:142, encoded by the cDNA, SEQ ID NO:143.

According to another embodiment of the present invention, there is provided a vault-like particle comprising MVP and VPARP or a portion of VPARP, where the MVP is modified by adding an amino acid sequence to the N-terminal or is modified by adding an amino acid sequence to the C-terminal, or is modified both by adding an amino acid sequence to the N-terminal and by adding an amino acid sequence to the C-terminal, and where the VPARP or portion of VPARP is modified by adding an amino acid sequence to the N-terminal or is modified by adding an amino acid sequence to the C-terminal, or is modified both by adding an amino acid sequence to the N-terminal and by adding an amino acid sequence to the C-terminal. The modifications can be any modification as disclosed in this disclosure, for the same purposes as disclosed in this disclosure.

In another embodiment of the present invention, there is provided a method of preventing damage by one or more than one substance to an organism, to a specific tissue, to specific cells, or to an environmental medium, by sequestering the one or more than one substance within a vault-like particle. The method comprises providing vault-like particles according to the present invention. The method further comprises administering the vault-like particles to the organism, tissue, cells or environmental medium, and allowing the vault-like particles to sequester the one or more than one substance within the vault-like particles.

In one embodiment, the vault-like particles comprise, consist essentially of or consist of a modified MVP according to the present invention. In another embodiment, the vault-like particles comprise a modified VPARP or portion of VPARP according to the present invention. In another embodiment, the vault-like particles comprise both a modified MVP according to the present invention, and a modified VPARP or portion of VPARP according to the present invention. In a preferred embodiment, the vault-like particles comprise, consist essentially of or consist of MVP modified by adding a peptide to the N-terminal to create a one or more than one of heavy metal binding domains. In one embodiment, the one or more than one substance is a heavy metal selected from the group consisting of cadmium, copper, gold and mercury. In another embodiment, the one or more than one substance is a toxin selected from the group consisting of arsenate, dioxin, an organochlorine, a pentachlorophenol and a polychlorinated biphenyl. In a preferred embodiment, the providing step comprises expressing the vault-like particles in a eukaryotic organisms, such as for example an *Acanthomoeba* sp., yeast or *Dictostelium discoidieum,* capable of proliferating in contaminated soil, and the administering step comprises introducing the organisms with the expressed vault-like particles into the contaminated soil. For example, vault-like particles comprising an arsenate reductase enzyme within the vault-like particles can be expressed in the organisms and used to detoxify soil. For example, in one embodiment, modified MVP is provided comprising one or more than one arsenate-binding domain at the N-terminal.

Arsenate reductase enzyme is cloned with residues 1473-1724 of human VPARP, SEQ ID NO:3 at either the C-terminal or the N-terminal. Both proteins are co-expressed in a primitive eukaryotic organisms, such as acanthomoeba, yeast or *Dictostelium discoidieum,* capable of proliferating in contaminated soil. The organisms engineered to contain the two modified proteins are introduced into contaminated soil, where they are exposed to the environmental toxin, such as arsenate. The expressed vault-like particles, comprising 96 or more copies of the arsenate-binding domain and the detoxification enzyme, arsenate reductase within the vault-like particles, then sequester and detoxify the environmental toxin, arsenate in the environmental medium.

In another embodiment of the present invention, there is provided a method of delivering one or more than one substance to an organism, to a specific tissue, to specific cells, or to an environmental medium. The method comprises providing vault-like particles according to the present invention comprising the one or more than one substance. The method further comprises administering the vault-like particles comprising the one or more than one substance to the organism, tissue, cells or environmental medium. In one embodiment, the vault-like particles comprise, consist essentially of or consist of a modified MVP according to the present invention, in addition to the one or more than one substance.

In another embodiment, the vault-like particles comprise a modified VPARP or modified portion of VPARP according to the present invention. In another embodiment, the vault-like particles comprise both a modified MVP according to the present invention, and a modified VPARP or modified portion of VPARP according to the present invention. In a preferred embodiment, the one or more than one substance is selected from the group consisting of an enzyme, a pharmaceutical agent, a plasmid, a polynucleotide, a polypeptide, a sensor and a combination of the preceding. In a particularly preferred embodiment, the substance is adenosine deaminase.

In another embodiment of the present invention, there is provided a method of delivering one or more than one sensor to an organism, to a specific tissue, to specific cells, or to an environmental medium. The method comprises providing a vault-like particle comprising the one or more than one sensor and administering the vault-like particle to the organism, specific tissue, specific cells, or environmental medium. In one embodiment, the vault-like particles comprise, consist essentially of or consist of a modified MVP according to the present invention, in addition to the one or more than one sensor. In another embodiment, the vault-like particles comprise a modified VPARP or modified portion of VPARP according to the present invention. In another embodiment, the vault-like particles comprise both a modified MVP according to the present invention, and a modified VPARP or modified portion of VPARP according to the present invention. The sensor can be any suitable sensor, as will be appreciated by one of ordinary skill in the art with reference to this disclosure, such as for example, a chemical sensor such as a cyclic-AMP binding protein, an ionic sensor such as a calcium or potassium sensor, a microorganism sensor such an antibody specific for *E. Coli,* an optical sensor such as a quantum dot, and a pH sensor such as green fluorescence protein. In a preferred embodiment, the sensor is a fluorescent sensor.

In another embodiment, the present invention is a method of detecting a signal from a sensor within an organism, or a specific tissue or specific cells. The method comprises delivering one or more than one sensor to an organism, to a specific tissue, to specific cells, or to an environmental medium, according to a method of the present invention. Then, the presence of the sensor is detected. Detection is performed using standard techniques, such as for example, fluorometry or spectrophotometry. This method can be used, for example, to determine the pH within cells, where the sensor is a pH dependent fluorescent sensor, as will be appreciated by one of ordinary skill in the art with reference to this disclosure.

According to another embodiment of the present invention, there is provided a method of making vault-like particles according to the present invention. The method comprises creating polynucleotide sequences encoding one or more than one polypeptide selected from the group consisting of MVP, modified MVP, VPARP, a portion of VPARP, modified VPARP, a modified portion of VPARP, TEP1, a portion of TEP1, modified TEP1 and a modified portion of TEP1, using standard molecular biological procedures, such as polymerase chain reaction and specific oligonucleotides, as will be appreciated by one of ordinary skill in the art with reference to this disclosure. Preferably, the polynucleotide sequences are used to generate a bacmid DNA that is used to generate a baculovirus comprising the sequence. The baculovirus is then used to infect insect cells for protein production using an in situ assembly system, such as the baculovirus protein expression system, according to standard techniques, as will be appreciated by one of ordinary skill in the art with reference to this disclosure. Advantageously, we have used the baculovirus protein expression system to produce milligram quantities of vault-like particles, and this system can be scaled up to allow production of gram quantities of vault-like particles according to the present invention.

In another embodiment of the present invention, there is provided a method of making vault-like particles having one or more than one substance, such as an enzyme, a pharmaceutical agent, a plasmid, a polynucleotide, a polypeptide, a sensor and a combination of the preceding, within the vault-like particles. The method comprises making the vault-like particles according to a method of the present invention. Next, the vault-like particles are purified using, such as for example, standard procedures over sucrose gradients. Then, the vault-like particles are co-incubated with one or more than one substance, until the one or more than one substance equilibrates within the vault-like particles or until enough of the one or more than one substance is loaded in the vault-like particles for the intended purpose.

EXAMPLES

Example 1

Preparation of *Chlamydia*-Vault-Like Particles (CVLPs)

To test whether barrel-shaped vaults can serve as carriers of immunogenic proteins, recombinant vault-like particles were used as carriers for the intranasal immunization of mice with the chlamydia MOMP protein. MOMP was chosen because of its immunogenic properties and ability to lessen development of infertility after *Chlamydia* infection [Ifere et al., *J. Microbiol. Immunol. Infect.,* 40(3):188-200 (2007); Pal et al., *Infect. Immun.,* 73(12):8153-60 (2005)]. FcR-mediated delivery has been proposed as an effective vaccination strategy and an adjuvant for boosting immune response against pathogens [Heijnen et al., *J. Clin. Invest.,* 97(2):331-8 (1996)] and enhancing cell-mediated immunity. Further, Th1 response and immunity against chlamydial genital infection is enhanced by FcR [Moore et al., *J. Infect. Dis.,* 188(4):617-24 (2003)]. The vaults were engineered to bind Ig through the Fc binding domain of protein A (Z domain, FIG. 1*a*) (SEQ ID NO:144) by expressing the Z domain on the exterior ends of the barrel. Vaults expressing the Z domain (SEQ ID NO:145) bound mouse IgG (FIG. 1*c*), indicating that vaults expressing the Z domain can enhance induction of T cell responses and protective vaginal immunity.

MOMP-INT -DNA (GenBank accession no. L19221; SEQ ID NO:146) encoding chlamydial MOMP protein (GenBank accession no. AAA16615; SEQ ID NO:147) was PCR-amplified from a pcDNA3 expression vector (Zhang et al., *Journal of Infectious Diseases,* 176(4):1035-40 (1997)) and fused to the vault interaction domain derived from VPARP (INT) (GenBank accession no. AF158255 (SEQ ID NO: 3), amino acids 1471-1724) to produce MOMP-INT (SEQ ID NO:148) (FIG. 1*a*). The MOMP-INT construct and a GL-INT construct (SEQ ID NO:59) were inserted into pFASTBAC™ TOPO® cloning vectors (Invitrogen) and the vectors were expressed in sf9 insect cells using the Bac-to-Bac® baculovirus expression system (Invitrogen) according to manufacturer's instructions.

Vault Expression and Purification—Recombinant vault-like particles were prepared by expressing rat MVP in sf9 insect cells essentially as described in Stephen et al., *J. Biol. Chem.,* 276(26):23217-20 (2001), which is hereby incorporated by reference in its entirety. Sf9 cells were maintained in Sf-900 II SFM media and grown at 27° C. Cultures were infected with a pFASTBAC™ expression vector comprising rat MVP at a multiplicity of infection (MOI) of 0.01 for approximately 65 h and cells were then pelleted and lysed on ice in buffer A [50 mM Tris-HCl (pH 7.4), 75 mM NaCl, and 0.5 mM $MgCl_2$] with 1% Triton X-100, 1 mM dithiothreitol, 0.5 mM PMSF, and protease inhibitor cocktail (2 μg/ml aprotinin, 0.5 μM benzamidine, 2 μg/ml chymostatin, 5 μM leupeptin, 5 μM pepstatin) (Sigma). Pelleted cells were incubated on ice for 20 min. and then homogenized 10 times with a type A Dounce. Unbroken cells, organelles, and membranes were pelleted by centrifugation at 20,000×g (S20) for 15 min at 4° C.

Large protein complexes (including vaults) were collected by further centrifugation of the supernatant at 100,000×g for 1 h at 4° C. The pellet (P100) was resuspended by Dounce homogenization with 1 ml of buffer A containing 1 mM dithiothreitol, 1 mM PMSF, and the protease inhibitor mixture. The P100 fraction was then adjusted to 7% sucrose and Ficoll and centrifuged at 43,000×g for 40 min. at 4° C. The supernatant was diluted 1:3 with buffer A containing 1 mM dithiothreitol, 1 mM PMSF, and the protease inhibitor mixture and centrifuged at 100,000×g for at least 3 h to pellet vaults. The pellet was resuspended by Dounce homogenization in 1 ml of buffer A containing 1 mM dithiothreitol, 1 mM PMSF, and the protease inhibitor mixture. To remove contaminating ribosomes, 500 μg of RNase A and 50 units of RNase TI (Ambion) were added and incubated for 20 min at room temperature. The insoluble ribosomal proteins were then pelleted by centrifugation at 20,000×g for 15 min at 4° C. The supernatant was loaded onto a sucrose step gradient of 20, 30, 40, 45, 50, and 60% sucrose steps and centrifuged at 78,000×g for 16 h. The fractions were collected and diluted 1:9 with buffer A containing 1 mM dithiothreitol, 1 mM PMSF, and the protease inhibitor mixture, and the vaults were pelleted by centrifugation at 100,000×g for 3 h. The pellets were then resuspended in 200 μl of buffer A containing 1 mM dithiothreitol, 1 mM PMSF, and the protease inhibitor mixture and analyzed by silver staining and Western blot.

*Chlamydia*-vault-like particles—MOMP-INT was incorporated into vaults by mixing purified vaults with supernatants of sf9 cells expressing MOMP-INT. The resulting chlamydia-vault-like particles (CVLPs) were centrifuged at 100,000×g (S100) and the pellet was electrophoresed on a 7% SDS-polyacrylamide gel. Western blot analysis using monoclonal antibodies specific for MOMP (MoPn40) and the VD1 portion of MVP indicated that the vaults contained MOMP (FIG. 1*b*). MOMP-INT and other proteins enter and attach to the interior of vault particles by an unknown mechanism (Stephen et al., *J. Biol. Chem.,* 276(26):23217-20 (2001)).

Example 2

Immunization with CVLPs

Immunization with MOMP-vaults reduces local bacterial burden following genital infection. Whether intranasal immunization with ChlamydiaVaults induces immunity was tested by giving mice 200 μg of ChlamydiaVaults via intranasal immunization which contained 20 μg MOMP as estimated by western blot analysis. This amount of peptide was determined to be immunogenic in other studies [Murthy et al., *Infect. Immun.,* 75(2):666-76 (2007); Pal et al., *Vaccine,* 24(6):766-75 (2006)]. As a negative control, GL-vaults were prepared by producing a construct containing modified green fluorescent protein (GL). Mice receiving 200 μg GL-vaults served as negative controls. Mice were given the vaults 3 times at two-week intervals. This regimen reduces infection following intravaginal challenge, as previously reported [Kelly et al., *Infect. Immun.,* 64:4976-83 (1996)]. As a positive control, a group of mice were immunized by a single intranasal (IN) infection with $1\times10^3$ IFU at the time of the first immunization dose. Immunized mice were then infected by intravaginal administration of $1.5\times10^5$ IFU MoPn two weeks after the last immunization and bacterial burden monitored by vaginal swabs collected every 3 days as reported [Maxion et al., *Infect. Immun.,* 72(11):6330-40 (2004)]. Delivery of 20 μg ChlamydiaVaults significantly reduced infection to levels similar to that of the positive control (FIG. 2*a*). Although anti-chlamydial immunity can be elicited in ISCOMs by parenteral immunization [Igietseme et al., *Infect. Immun.,* 68(12):6798-806 (2000); Dong-Ji et al., *Infect. Immun.,* 68(6):3074-8 (2000)], this is the first report of anti-chlamydial immunity induced by a protein delivered via a mucosal route in the absence of an adjuvant [Murthy et al., *Infect. Immun.,* 75(2):666-76 (2007)] or a live microbial vector [He et al., *Immunology,* 122(1):28-37 (2007)]. Thus, delivery of ChamydiaVault was effective at inducing protective immunity by reducing the magnitude of a mucosal infection upon intravaginal challenge with MoPn.

Eradication of chlamydial infection is depended on Th1 cells. We analyzed IFNγ+IL-4−CD4+CD3+ cells induced in response to whole chlamydiae organisms by flow cytometry as described previously [Maxion et al., *Infect. Immun.,* 72(11):6330-40 (2004)]. Confirming the protection data, mice immunized with ChlamydiaVaults developed statistically similar levels of IFNγ+IL-4−CD4+CD3+ Th1 cells in the spleen. The splenic compartment is reflective of central immune system and possibly, a greater number of anti-chlamydial responsive IFNγ cells are found in mucosal draining lymph nodes or the genital mucosae of the mucosal immune system of ChlamydiaVault immunized mice.

Primary exposure of *C. muridarum* by mucosal routes results in higher serum levels of the Th1-associated anti-MoPn IgG2a or IgGc versus the Th2 associated anti-MoPn IgG1 and is associated with protection. Protective MOMP-vault immunization resulted in lower levels of both IgGc and IgG1 and also a significantly lowered ratio of IgGc:IgG1 (FIG. 2*c*). However, the lowered anti-MoPn antibody ratio was not associated with a non-protective Th2 response since all immunization groups similar percentages of anti-MoPn responsive Th2 (FIG. 2*d*) cells suggesting the MOMP-vault immunization reduces inflammation within the genital tract during a challenge with *C. muridarum*. The inflammation was not mediated by increased IL-17 cells since MoPn-responsive Th17 cells were not found following immunization with intranasal instillation of live *C. muridarum* or immunization with MOMP or GL-vaults. Taken together, the data shows that MOMP delivered in vaults induces anti-chlamydial immunity capable of reducing infection following intravaginal challenge.

*Chlamydia—C. muridarum* (MoPn) used for immunizations and challenge were grown on confluent Hela (Hela MoPn) and McCoy (McCoy MoPn) cell monolayers, respectively. Elementary bodies were purified on Renograffin gradients following sonication and aliquots stored at −70° C. in SPG buffer (sucrose-phosphate-glutamine).

Immunization and antigen challenge—Female C57B1/6 mice, 5-6 weeks old, were purchased from Harlan Sprague-Dawley (Indianapolis, Ind.) and were housed according to American Association of Accreditation of Laboratory Animal Care guidelines. Experimental procedures were approved by the UCLA Institutional Animal Care and Use Committee. Mice were divided into 3 groups (12 mice/group) and anesthetized with 10% ketamine and 10% xylazine and immunized intranasally (i.n.) with either live Hela MoPn ($1\times10^3$ IFUs), 200 ug MOMP-vaults, or 200 ug GL-vaults in 30 ul PBS. Mice were immunized i.n. a total of 3 times every two weeks. Mice immunized with live Hela MoPn received only one immunization. On day 41 post-immunization, half the mice from each group were euthanized to collect blood and spleens for analysis of humoral and cellular responses. A challenge experiment was performed on the remaining mice. Mice were first injected subcutaneously with 2.5 mg of medroxyprogesterone acetate (Upjohn, Kalamazoo, Mich.) in 100 µl of sterile phosphate-buffered saline. Medroxyprogesterone acetate drives mice into a state of anestrous thus eliminating the variability in the rate and severity of infection due to the estrus cycle. Seven days later, while under anesthesia, mice were challenged by vaginal inoculation with $1.5 \times 10^5$ IFUs of McCoy MoPn. Infection was monitored by obtaining cervical-vaginal swabs (Dacroswab Type 1, Spectrum Labs, Houston, Tex.) every 3 days. Swabs were stored in sucrose-phosphate buffer at $-70°$ C. until analyzed, as previously described. Mice were euthanized 15 days post-challenge and blood was collected in addition to the spleens for analysis of humoral and cellular responses.

Gel electrophoresis and immunoblotting—Sodium dodecyl sulfate-polyacrylamide gel electrophoresis was performed using the discontinuous buffer system described by Laemmli, *Nature*, 227:680 (1970) and 10% acrylamide gels. Electrophoresis was performed using a Mini-PROTEAN II cell (Bio-Rad Laboratories, Richmond, Calif.) for 60 min at 180 V in Tris-glycine running buffer (25 mM Tris, 192 mM glycine, 0.1% sodium dodecyl sulfate, pH 8.3). Protein samples of MoPn, MOMP-vaults, and GL-vaults were transferred to an Immobilon-P transfer membrane (Millipore, Bedford, Mass.) and blocked with 5% (wt/vol) nonfat dry milk in PBS-0.1% Tween 20 (PBS-T). Membranes were individually incubated for 1 h either with antiserum raised against Live CT (1:500 dilution), MOMP-vaults (1:500), GL-vaults (1:500), anti-MoPn-40 (1:5000) followed by a 1-h incubation with horseradish peroxidase-donkey anti-mouse immunoglobulin G (IgG) conjugate (1:5,000 dilution; Amersham Biosciences, Piscataway, N.J.). Bound conjugates were detected with SuperSignal West Dura extended duration substrate (Pierce Biotechnology Inc., Rockford, Ill.) and an Alpha Innotech Fluorchem 8000 imager. Integrated density values of immunoblots were obtained using the Fluor Chem software, version 3.04A (Alpha Innotech Corporation, San Leandro, Calif.).

Isolation of Splenocytes—Single-cell suspensions were prepared from individual spleens by mechanical disruption through 70-µm cell strainers (Falcon, Becton Dickinson, Franklin Lakes, N.J.) in Isolation media (1× Hanks Balance Salt Solution, 20 mM HEPES, pH 7.4). Erythrocytes were lysed with ACK lysis buffer (0.15 M $NH_4Cl$, 10 mM $KHCO_3$, 0.1 mM $Na_2EDTA$), and washed twice with Isolation buffer. For intracellular cytokine analysis, cells were cultured ($2 \times 10^6$/ml) for 44 h at 37° C. in RPMI medium containing 10% fetal bovine serum, 200 mM glutamine, 10,000 U of penicillin/ml, 10,000 µg of streptomycin/ml, 1 M nonessential amino acids, 1 M HEPES, 1 M sodium pyruvate, 5 µM 2-mercaptoethanol, and 5 µg of UV-inactivated *C. muridarum* elementary bodies/ml purified by Renografin-60 (Bracco Diagnostics, Princeton, N.J.) gradient centrifugation (Kelly et al., *Infect. Immun.*, 65:5198-208 (1997)). For the last 4 h of their stimulation, the cells were treated with GolgiPlug (BD Pharmingen) according to the manufacturer's recommendation.

Example 3

Incorporation of CVLPs by Dendritic Cells

Vaults are internalized by mature dendritic cells in vitro. We evaluated vault-induced endocytosis using a standard uptake assay in comparison with the uptake of FITC-dextran. The standard uptake assay measures the ability of immature DCs to incorporate particles such as polystyrene beads or dextran. This is visualized by conjugating modified GL to the INT domain and producing GL-vaults as described above. Immature bone marrow derived dendritic cells (BMDCs) were produced from mice as described previously [Lutz et al., *J. Immunol. Methods*, 223(1):77-92 (1999)]. The cells were found to be immature by the lack of expression of MHC class II and other co-stimulatory molecules [Liu et al., *Immunology*, 123(2):290-303 (2007)]. The immature BMDCs ($1 \times 10^6$) were incubated with media, GL-vaults (500 µg) or FITC-dextran (250 µg) for 30-60 minutes at 37° C. These cells were collected and stained for CD11c-PE a cell surface marker of murine DCs and analyzed using a flow cytometer (FACS Calibur, Dickinson Corp).

CD11c+ BMDCs incubated with GL-Vaults incorporated vaults at a slower rate of compared to FITC-dextran (FIG. 3a). However, incubation of GL-vaults with BMDCs for various times showed that vaults, containing the small protein, GL, were incorporated by BMDCs in a similar time scale as the FITC-dextran control suggesting that they use a similar mechanism for incorporation. It is possible that vaults adhere to the surface of cells and are not internalized. To address this, a portion of the BMDCs were fixed on poly-Llysine coated slides and evaluated for incorporated vaults (green). Our analysis showed that vaults containing the GL protein were internalized by BMDCs (red) and appeared more concentrated in the DC cytoplasm than the control FITC-dextran (green) (FIG. 2b). This is likely due adherence of FITC-dextran to the DC surface (FIG. 2b, left panels). Taken together, our data show that vaults are internalized by immature BMDCs.

Bone marrow dendritic cell differentiation—Briefly, bone marrow cells were isolated from the tibias of mice and cultured with 20 ng GM-CSF for six days in RPMI-1640 supplemented with 10% heat-inactivated FCS (Gibco), 2 mM L-glutamine (Gibco), 50 µM of 2-ME (Gibco), 100 U/ml penicillin (Gibco), streptomycin (Gibco), and 20 ng/ml (200 U/ml) recombinant mouse GM-CSF (Invitrogen Corp). At day 6, the cells were enriched by positive selection using magnetic microbeads conjugated to a cell surface molecule expressed on all murine DCs, anti-mouse CD11c mAb (Miltenyi Biotec), following the manufacturers' protocol. Purity of approximately 94% was achieved as assessed by flow cytometry.

Example 4

Induction of Antibodies

Immunization with peptide containing vaults induces antipeptide IgG. The clearance of a chlamydial genital infection is dependent on CD4 cells that secrete IFNγ while antibody levels enhance clearance in immune mice [Murthy et al., *Infect. Immun.*, 75(2):666-76 (2007); Ifere et al., *J. Microbiol. Immunol. Infect.*, 40(3):188-200 (2007); Morrison et al., *J. Immunol.*, 175(11):7536-42 (2005)]. We measured levels of serum antibody generated in mice following our immunization regimen but before vaginal challenge. As you can see in FIG. 4a, mice immunized with vaults containing the MOMP or GL protein produced only background levels of IgG antibody against whole chlamydial elementary bodies while mice given a single intranasal infection with MoPn produced significant anti-MoPn IgG antibody. However, the proportion of anti-MOMP IgG in mice, which were immunized with the MOMP-vaults, was 25% while those intranasally infected with chlamydiae only generated 2% anti-MOMP Ab of total anti-MoPn IgG (FIG. 4b). This likely is due to IgG antibodies generated against other chlamydial proteins as shown by Western blot analysis of whole chlamydiae blotted with sera from mice immunized with live CT by intranasal exposure (FIG. 4c). Similarly, sera from mice immunized with GL-vaults contained antibody which bound GFP (FIG. 4d) indicating that immunization with vaults containing peptides induced the generation of peptide-specific antibody.

Anti-vault antibody development depends on the immunogenic peptide in a vault. Vaults are ubiquitous self particles found in nearly all eukaryotic cells and would not be expected to induce antibody against itself [Izquierdo et al., *Am. J. Pathol.*, 148(3):877-87 (1996)]. The vast majority (75%) of the vault mass consists of the major vault protein (MVP) [Kedersha et al., *J. Cell Biol.*, 112(2):225-35 (1991)] and patients with a variety of autoimmune diseases were not found to contain any serum IgG against MVP (personal communication Leonard H. Rome). However, vaults containing foreign peptides are engulfed by DCs (FIG. 3) and could possibly produce antibody to a self protein. We tested this possibility in serum pools of mice following the full immunization regimen but before challenge infection. Western blot analysis showed that mice immunized with Live CT or GL-vaults did not produce IgG against vaults as compared to the (FIGS. 5a & b). This was confirmed with anti-vault ELISA assays on individual sera (FIG. 5c).

Antibodies and Flow Cytometry—The following anti-mouse monoclonal antibodies (mAb) were used for flow cytometry: anti-CD3-APC (clone 1145-2C11), anti-IFN-gamma-FITC (clone XMG1.2), anti-IL-4-PE (clone 11B11), and anti-FoxP3-PE (clone FJK-16s). Antibodies and their respective isotypes, used as negative controls for surface and intracellular staining, were purchased from eBioscience, except for anti-IL-17-PE (clone Tc11-18H10.1) (BioLegend), and anti-CD4-PerCP (clone RM4-5) (BD Biosciences). For intracellular cytokine staining, cultured cells were purified by density gradient centrifugation using Lympholyte M (Cedarlane Laboratories, Ontario, Canada) according to the manufacturer's protocol. Cells were resuspended in cold 1% FACS buffer (1% BSA in Hanks Balance Salt Solution with 0.1% $NaN_3$) and blocked with anti-CD16/CD32 (Fc-Block) (eBioscience) prior to incubation with specific staining antibodies. For surface staining, $1\times10^6$ cells were incubated with saturating concentrations of appropriate antibodies for 30 min at 4° C. in the dark, then washed twice in cold 1% FACS buffer before fixation for intracellular staining. Cells were incubated in fixation/permeabilization solution (eBioscience) for 45 min. in the dark at 4° C. Cells were washed in permeabilization buffer (eBioscience) and incubated with the appropriate antibodies for 30 min in the dark at 4° C. Cells were then washed twice in permeabilization buffer. Following the washing step, the cells were fixed in phosphate-buffered saline containing 1% paraformaldehyde and kept at 4° C. until analyzed.

A novel vaccine platform is described herein which is effective at producing cellular immunity at mucosal surfaces. In some preferred aspects, intranasal immunization using peptides contained within vault nanoparticles produces immunity which significantly reduces bacterial load within genital tissue following genital challenge with *C. muridarum*. Moreover, immunization with vault nanoparticles containing immunogenic peptides reduces both cellular and humoral immunity compared to immunity induced via a prior infection. Since repeated infections increase inflammation and reproductive dysfunction, reducing unnecessary inflammation using methods and compositions provided herein provides a new avenue for reducing immune-mediated pathology and morbidity following *C. trachomatis* STIs [Brunham et al., *Nat. Rev. Immunol.*, 5(2):149-61 (2005)]. Recently, Darville, T. et al. reported that kinetics of chlamydial eradication in vivo was similar in a strain of *C. muridarum* which dramatically lowered TNFα levels in vivo during infection [O'Connell et al., *J. Immunol.*, 179(6):4027-34 (2007)]. Thus, immunization using vault nanoparticles is an ideal vaccine platform for inducing immunity while reducing inflammation.

MOMP vaults were sometimes observed to induce IgG to MVP but not mice exposed to GL-vaults. The lack of reactivity against MVP in GL-vault immunized mice was not due to the inability of GL-vaults to induce an immune response since mice given GL-vaults generated antibody against GL-INT. It is also unlikely that cross reactive antibody developed in these mice since mice immunized with Live CT did not produce anti-MVP IgG. In addition, MOMP has not been reported to induce antibodies that react against host proteins [Brunham et al., *Nat. Rev. Immunol.*, 5(2):149-61 (2005)]. Development of antivault antibodies would be expected to enhance clearance and reduce immunity, but MOMP-vault immunized mice since they were protected to the same degree as those preexposed to a live infection. One possibility is that vaults act as an antigen-depot within DCs prolonging immunity and only require one exposure instead of three. Another interpretation is that the MOMP sequence itself contains one or multiple pathogen associated molecular patterns (PAMPs) which activates cellular pathways within DCs to efficiently induce an anti-vault immune response.

Although the present invention has been discussed in considerable detail with reference to certain preferred embodiments, other embodiments are possible. Therefore, the scope of the appended claims should not be limited to the description of preferred embodiments contained in this disclosure. All references cited herein are incorporated by reference to their entirety.

SEQUENCE LISTING (148 sequences)

SEQ ID NO: 1 - protein, 893 aa, Homo sapiens
MATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLR

SEQ ID NO: 2 - DNA, 2682 bp, Homo sapiens
atggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaa

SEQ ID NO: 3 - protein, 1724 aa, Homo sapiens [sequence omitted]

SEQ ID NO: 4 - DNA, 5175 bp, Homo sapiens
atggtgatgggaatctttgcaaattgtatcttctgtttgaaagtgaagtacttacctcagcagcagaagaaaaagctacaaactgacattaaggaaaatggcggaaagttttccttttcgttaaatcctcagtgcacacatataatcttagataatgctgatgttctgagtcagtaccaactgaattctatccaaaagaaccacgttcatattgcaaacccagattttatatggaaatctatcagagaaaagagactcttggatgtaaagaattatgatccttataagcccctggacatcacaccacctcctgatcagaaggcgagcagttctgaagtgaaaacagaaggtctatgcccggacagtgccacagaggaggaagacactgtggaactcactgagtttggtatgcagaatgttgaaattcctcatcttcctcaagattttgaagttgcaaaatataacaccttggagaaagtgggaatggagggaggccaggaagctgtggtggtggagcttcagtgttcgcgggactccagggactgtcctttcctgatatcctcacacttcctcctggatgatggcatggagactagaagacagtttgctataaagaaaacctctgaagatgcaagtgaatactttgaaaattacattgaagaactgaagaaacaaggatttctactaagagaacatttcacacctgaagcaacccaattagcatctgaacaattgcaagcattgcttttggaggaagtcatgaattcaagcactctgagccaagaggtgagcgatttagtagagatgatttgggcagaggccctgggccacctggaacacatgcttctcaagccagtgaacaggattagcctcaacgatgtgagcaaggcagaggggattctccttctagtaaaggcagcactgaaaaatggagaaacagcagagcaattgcaaaagatgatgacagagttttacagactgatacctcacaaaggcacaatgcccaaagaagtgaacctgggactattggctaagaaagcagacctctgccagctaataagagacatggttaatgtctgtgaaactaatttgtccaaacccaacccaccatccctggccaaataccgagctttgaggtgcaaaattgagcatgttgaacagaatactgaagaatttctcagggttagaaaagaggttttgcagaatcatcacagtaagagcccagtggatgtcttgcagatatttagagttggcagagtgaatgaaaccacagagtttttgagcaaacttggtaatgtgaggcccttgttgcatggttctcctgtacaaaacatcgtgggaatcttgtgtcgagggttgcttttacccaaagtagtggaagatcgtggtgtgcaaagaacagacgtcggaaaccttggaagtgggatttatttcagtgattcgctcagtacaagtatcaagtactcacacccgggagagacagatggcaccagactcctgctcatttgtgacgtagccctcggaaagtgtatggacttacatgagaaggactttcccttaactgaagcaccaccaggctacgacagtgtgcatggagtttcacaaacagcctctgtcaccacagactttgaggatgatgaatttgttgtctataaaaccaatcaggttaaaatgaaatatattattaaattttccatgcctggagatcagataaaggactttcatcctagtgatcatactgaattagaggaatacagacctgagttttcaaatttttcaaaggttgaagattaccagttaccagatgccaaaacttccagcagcaccaaggccggcctccaggatgcctctgggaacttggttcctctggaggatgtccacatcaaagggagaatcatagacactgtagcccaggtcattgtttttcagacatacacaaataaaagtcacgtgcccattgaggcaaaatatatctttcctttggatgacaaggccgctgtgtgtggcttcgaagccttcatcaatgggaagcacatagttggagagattaaagagaaggaagaagcccagcaagagtacctagaagccgtgacccagggccatggcgcttacctgatgagtcaggatgctccggacgtttttactgtaagtgttggaaacttaccccctaaggctaaggttcttataaaaattacctacatcacagaactcagcatcctgggcactgttggtgtctttttcatgcccgccaccgtagcaccctggcaacaggacaaggctttgaatgaaaaccttcaggatacagtagagaagatttgtataaaagaaataggaacaaagcaaagcttctctttgactatgtctattgagatgccgtatgtgattgaattcattttcagtgatacacatgaactgaaacaaaagcgcacagactgcaaagctgtcattagcaccatggaaggcagctccttagacagcagtggattttctctccacatcggtttgtctgctgcctatctcccaagaatgtgggttgaaaaacatccagaaaaagaaagcgaggcttgcatgcttgtctttcaacccgatctcgatgtcgacctccctgacctagccagtgagagcgaagtgattatttgtcttgactgctccagttccatggagggtgtgacattcttgcaagccaagcaaatcaccttgcatgcgctgtccttggtgggtgagaagcagaaagtaaatattatccagttcggcacaggttacaaggagctattttcgtatcctaagcatatcacaagcaataccacggcagcagagttcatcatgtctgccacacctaccatggggaacacagacttctggaaaacactccgatatcttagcttattgtaccctgctcgagggtcacggaacatcctcctggtgtctgatgggcacctccaggatgagagcctgacattacagctcgtgaagaggagccgcccgcacaccaggttattcgcctgcggtatcggttctacagcaaatcgtcacgtcttaaggattttgtcccagtgtggtgccggagtatttgaatattttaatgcaaaatccaagcatagttggagaaaacagatagaagaccaaatgaccaggctatgttctccgagttgccactctgtctccgtcaaatggcagcaactcaatccagatgcgcccgaggccctgcaggccccagcccaggtgccatccttgtttcgcaatgatcgactccttgtctatggattcattcctcactgcacacaagcaactctgtgtgcactaattcaagagaaagaattttgtacaatggtgtcgactactgagcttcagaagacaactggaactatgatccacaagctggcagcccgagctctaatcagagattatgaagatggcattcttcacgaaaatgaaaccagtcatgagatgaaaaaacaaaccttgaaatctctgattattaaactcagtaaagaaaactctctcataacacaatttacaagctttgtggcagttgagaaaagggatgagaatgagtcgccttttcctgatattccaaaagtttctgaacttattgccaaagaagatgtagacttcctgccctacatgagctggcagggggagccccaagaagccgtcaggaaccagtctcttttagcatcctctgagtggccagaattacgtttatccaaacgaaaacataggaaaattccattttccaaaagaaaaatggaattatctcagccagaagtttctgaagattttgaagaggatggcttaggtgtactaccagctttcacatcaaatttggaacgtggaggtgtggaaaagctattggatttaagttggacagagtcatgtaaaccaacagcaactgaaccactatttaagaaagtcagtccatgggaaacatctacttctagcttttttcctattttggctccggccgttggttcctatcttaccccgactacccgcgctcacagtcctgcttccttgtcttttgcctcatatcgtcaggtagctagtttcggttcagctgctcctcccagacagtttgatgcatctcaattcagccaaggccctgtgcctggcacttgtgctgactggatcccacagtcggcgtcttgtcccacaggacctccccagaacccaccttctgcaccctattgtggcattgttttttcagggagctcattaagctctgcacagtctgctccactgcaacatcctggaggctttactaccaggccttctgctggcaccttccctgagctggattctccccagcttcatttctctcttcctacagaccctgatcccatcagaggttttgggtcttatcatccctctgcttactctccttttcattttcaaccttccgcagcctctttgactgccaaccttaggctgccaatggcctctgctttacctgaggctctttgcagtcagtcccggactaccccagtagatctctgtcttctagaagaatcagtaggcagtctcgaaggaagtcgatgtcctgtctttgcttttcaaagttctgacacagaaagtgatgagctatcagaagtacttcaagacagctgctttttacaaataaagtgtgatacaaaagatgacagtatcccgtgctttctggaattaaaagaagaggatgaaatagtgtgcacacaacactggcaggatgctgtgccttggacagaactcctcagtctacagacagaggatggcttctggaaacttacaccagaactgggacttatattaaatcttaatacaaatggtttgcacagctttcttaaacaaaaaggcattcaatctctaggtgtaaaaggaagagaatgtctcctggacctaattgccacaatgctggtactacagtttattcgcaccaggttggaaaaagagggaatagtgttcaaatcactgatgaaaatggatgacccttctatttccaggaatattccctgggcttttgaggcaataaagcaagcaagtgaatgggtaagaagaactgaaggacagtacccatctatctgcccacggcttgaactggggaacgactgggactctgccaccaagcagttgctgggactccagcccataagcactgtgtcccctcttcatagagtcctccattacagtcaaggctaa

SEQ ID NO: 5 - protein, 2627 aa, Homo sapiens
MEKLHGHVSAHPDILSLENRCLAMLPDLQPLEKLHQHVSTHSDILSLKNQCLATLPDLKTMEKPHGYVSAHPDILSLENQCLATLSDLKTMEKPHGHVSAHPDILSLENRCLATLPSLKSTVSASPLFQSLQISHMTQADLYRVNNSNCLLSEPPSWRAQHFSKGLDLSTCPIALKSISATETAQEATLGRWFDSEEKKGAETQMPSYSLSLGEEEEVEDLAVKLTSGDSESHPEPTDHVLQEKKMALLSLLCSTLVSEVNMNNTSDPTLAAIFEICRELALLEPEFILKASLYARQQLNVRNVANNILAIAAFLPACRPHLRRYFCAIVQLPSDWIQVAELYQSLAEGDKNKLVPLPACLRTAMTDKFAQFDEYQLAKYNPRKHRAKRHPRRPPRSPGMEPPFSHRCFPRYIGFLREEQRKFEKAGDTVSEKKNPPRFTLKKLVQRLHIHKPAQHVQALLGYRYPSNLQLFSRSRLPGPWDSSRAGKRMKLSRPETWERELSLRGNKASVWEELIENGKLPFMAMLRNLCNLLRVGISSRHHELILQRLQHGKSVIHSRQFPFRFLNAHDAIDALEAQLRNQALPFPSNITLMRRILTRNEKNRPRRRFLCHLSRQQLRMAMRIPVLYEQLKREKLRVHKARQWKYDGEMLNRYRQALETAVNLSVKHSLPLLPGRTVLVYLTDANADRLCPKSNPQGPPLNYALLLIGMMITRAEQVDVVLCGGDTLKTAVLKAEEGILKTAIKLQAQVQEFDENDGWSLNTFGKYLLSLAGQRVPVDRVILLGQSMDDGMINVAKQLYWQRVNSKCLFVGILLRRVQYLSTDLNPNDVTLSGCTDAILKFIAEHGASHLLEHVGQMDKIFKIPPPPGKTGVQSLRPLEEDTPSPLAPVSQQGWRSIRLFISSTFRDMHGERDLLLRSVLPALQARAAPHRISLHGIDLRWGVTEEETRRNRQLEVCLGEVENAQLFVGILGSRYGYIPPSYNLPDHPHFHWAQQYPSGRSVTEMEVMQFLNRNQRLQPSAQALIYFRDSSFLSSVPDAWKSDFVSESEEAACRISELKSYLSRQKGITCRRYPCEWGGVAAGRPYVGGLEEFGQLVLQDVWNMIQKLYLQPGALLEQPVSIPDDDLVQATFQQLQKPPSPARPRLLQDTVQQLMLPHGRLSLVTGQSGQGKTAFLASLVSALQAPDGAKVAPLVFFHFSGARPDQGLALTLLRRLCTYLRGQLKEPGALPSTYRSLVWELQQRLLPKSAESLHPGQTQVLIIDGADRLVDQNGQLISDWIPKKLPRCVHLVLSVSSDAGLGETLEQSQGAHVLALGPLEASARARLVREELALYGKRLEESPFNNQMRLLLVKRESGRPLYLRLVTDHLRLFTLYEQVSERLRTLPATVPLLLQHILSTLEKEHGPDVLPQALTALEVTRSGLTVDQLHGVLSVWRTLPKGTKSWEEAVAAGNSGDPYPMGPFACLVQSLRSLLGEGPLERPGARLCLPDGPLRTAAKRCYGKRPGLEDTAHILIAAQLWKTCDADASGTFRSCPPEALGDLPYHLLQSGNRGLLSKFLTNLHVVAAHLELGLVSRLLEAHALYASSVPKEEQKLPEADVAVFRTFLRQQASILSQYPRLLPQQAANQPLDSPLCHQASLLSRRWHLQHTLRWLNKPRTMKNQQSSSLSLAVSSSPTAVAFSTNGQRAAVGTANGTVYLLDLRTWQEEKSVVSGCDGISACLFLSDDTLFLTAFDGLLELWDLQHGCRVLQTKAHQYQITGCCLSPDCRLLATVCLGGCLKLWDTVRGQLAFQHTYPKSLNCVAFHPEGQVIATGSWAGSISFFQVDGLKVTKDLGAPGASIRTLAFNVPGGVVAVGRLDSMVELWAWREGARLAAFPAHHGFVAAALFLHAGCQLLTAGEDGKVQVWSGSLGRPRGHLGSLSLSPALSVALSPDGDRVAVGYRADGIRIYKISSGSQGAQGQALDVAVSALAWLSPKVLVSGAEDGSLQGWALKECSLQSLWLLSRFQKPVLGLATSQELLASASEDFTVQLWPRQLLTRPHKAEDFPCGTELRGHEGPVSCCSFSTDGGSLATGGRDRSLLCWDVRTPKTPVLIHSFPACHRDWVTGCAWTKDNLLISCSSDGSVGLWDPESGQRLGQFLGHQSAVSAVAAVEEHVVSVSRDGTLKVWDHQGVELTSIPAHSGPISHCAAAMEPRAAGQPGSELLVVTVGLDGATRLWHPLLVCQTHTLLGHSGPVRAAAVSETSGLMLTASEDGSVRLWQVPKEADDTCIPRSSAAVTAVAWAPDGSMAVSGNQAGELILWQEAKAVATAQAPGHIGALIWSSAHTFFVLSADEKISEWQVKLRKGSAPGNLSLHLNRILQEDLGVLTSLDWAPDGHFLILAKADLKLLCMKPGDAPSEIWSSYTENPMILSTHKEYGIFVLQPKDPGVLSFLRQKESGEFEERLNFDINLENPSRTLISITQAKPESESSFLCASSDGILWNLAKCSPEGEWTTGNMWQKKANTPETQTPGTDPSTCRESDASMDSDASMDSEPTPHLKTRQRRKIHSGSVTALHVLPELLVTASKDRDVKLWERPSMQLLGLFRCEGSVSCLEPWLGANSTLQLAVGDVQGNVYFLNWE

SEQ ID NO: 6 - DNA, 7884 bp, Homo sapiens
atggaaaaactccatgggcatgtgtctgcccatccagacatcctctccttggagaaccggtgcctggctatgctccctgacttacagcccttggagaaactacatcagcatgtatctacccactcagatatcctctccttgaagaaccagtgcctagccacgcttcctgacctgaagaccatggaaaaaccacatggatatgtgtctgcccacccagacatcctctccttggagaaccagtgcctggccacactttctgacctgaagaccatggagaaaccacatggacatgtttctgcccacccagacatcctctccttggagaaccggtgcctggccaccctccctagtctaaagagcactgtgtctgccagccccttgttccagagtctacagatatctcacatgacgcaagctgatttgtaccgtgtgaacaacagcaattgcctgctctctgagcctccaagttggagggctcagcatttctctaagggactagacctttcaacctgccctatagccctgaaatccatctctgccacagagacagctcaggaagcaactttgggtcgttggtttgattcagaagagaagaaaggggcagagacccaaatgccttcttatagtctgagcttgggagaggaggaggaggtggaggatctggccgtgaagctcacctctggagactctgaatctcatccagagcctactgaccatgtccttcaggaaaagaagatggctctactgagcttgctgtgctctactctggtctcagaagtaaacatgaacaatacatctgaccccaccctggctgccatttttgaaatctgtcgtgaacttgccctcctggagcctgagtttatcctcaaggcatctttgtatgccaggcagcagctgaacgtccggaatgtggccaataacatcttggccattgctgctttcttgccggcgtgtcgcccccacctgcgacgatatttctgtgccattgtccagctgccttctgactggatccaggtggctgagctttaccagagcctggctgagggagataagaataagctggtgcccctgcccgcctgtctccgtactgccatgacggacaaatttgcccagtttgacgagtaccagctggctaagtacaaccctcggaagcaccgggccaagagacacccccgccggccaccccgctctccagggatggagcctccattttctcacagatgttttccaaggtacatagggtttctcagagaagagcagagaaagtttgagaaggccggtgatacagtgtcagagaaaaagaatcctccaaggttcaccctgaagaagctggttcagcgactgcacatccacaagcctgcccagcacgttcaagccctgctgggttacagatacccctccaacctacagctcttttctcgaagtcgccttcctgggccttgggattctagcagagctgggaagaggatgaagctgtctaggccagagacctgggagcgggagctgagcctacgggggaacaaagcgtcggtctgggaggaactcattgaaaatgggaagcttcccttcatggccatgcttcggaacctgtgcaacctgctgcgggttggaatcagttcccgccaccatgagctcattctccagagactccagcatgggaagtcggtgatccacagtcggcagtttccattcagatttcttaacgcccatgatgccattgatgccctcgaggctcaactcagaaatcaagcattgccctttccttcgaatataacactgatgaggcggatactaactagaaatgaaaagaaccgtcccaggcggaggtttctttgccacctaagccgtcagcagcttcgtatggcaatgaggatacctgtgttgtatgagcagctcaagagggagaagctgagagtacacaaggccagacagtggaaatatgatggtgagatgctgaacaggtaccgacaggccctagagacagctgtgaacctctctgtgaagcacagcctgcccctgctgccaggccgcactgtcttggtctatctgacagatgctaatgcagacaggctctgtccaaagagcaacccacaagggcccccgctgaactatgcactgctgttgattgggatgatgatcacgagggcggagcaggtggacgtcgtgctgtgtggaggtgacactctgaagactgcagtgcttaaggcagaagaaggcatcctgaagactgccatcaagctccaggctcaagtccaggagtttgatgaaaatgatggatggtccctgaatacttttgggaaatacctgctgtctctggctggccaaagggttcctgtggacagggtcatcctccttggccaaagcatggatgatggaatgataaatgtggccaaacagctttactggcagcgtgtgaattccaagtgcctctttgttggtatcctcctaagaagggtacaatacctgtcaacagatttgaatcccaatgatgtgacactctcaggctgtactgatgcgatactgaagttcattgcagagcatggggcctcccatcttctggaacatgtgggccaaatggacaaaatattcaagattccaccacccccaggaaagacaggggtccagtctctccggccactggaagaggacactccaagccccttggctcctgtttcccagcaaggatggcgcagcatccggcttttcatttcatccactttccgagacatgcacggggagcgggacctgctgctgaggtctgtgctgccagcactgcaggcccgagcggcccctcaccgtatcagccttcacggaatcgacctccgctggggcgtcactgaggaggagacccgtaggaacagacaactggaagtgtgccttggggaggtggagaacgcacagctgtttgtggggattctgggctcccgttatggatacattccccccagctacaaccttcctgaccatccacacttccactgggcccagcagtacccttcagggcgctctgtgacagagatggaggtgatgcagttcctgaaccggaaccaacgtctgcagccctctgcccaagctctcatctacttccgggattccagcttcctcagctctgtgccagatgcctggaaatctgactttgtttctgagtctgaagaggccgcatgtcggatctcagaactgaagagctacctaagcagacagaaagggataacctgccgcagatacccctgtgagtgggggggtgtggcagctggccggccctatgttggcgggctggaggagtttgggcagttggttctgcaggatgtatggaatatgatccagaagctctacctgcagcctggggccctgctggagcagccagtgtccatcccagacgatgacttggtccaggccaccttccagcagctgcagaagccaccgagtcctgcccggccacgccttcttcaggacacagtgcaacagctgatgctgccccacggaaggctgagcctggtgacggggcagtcaggacagggcaagacagccttcctggcatctcttgtgtcagccctgcaggctcctgatggggccaaggtggcaccattagtcttcttccacttttctggggctcgtcctgaccagggtcttgccctcactctgctcagacgcctctgtacctatctgcgtggccaactaaaagagccaggtgccctccccagcacctaccgaagcctggtgtgggagctgcagcagaggctgctgcccaagtctgctgagtccctgcatcctggccagacccaggtcctgatcatcgatggggctgataggttagtggaccagaatgggcagctgatttcagactggatcccaaagaagcttccccggtgtgtacacctggtgctgagtgtgtctagtgatgcaggcctaggggagacccttgagcagagccagggtgcccacgtgctggccttggggcctctggaggcctctgctcgggcccggctggtgagagaggagctggccctgtacgggaagcggctggaggagtcaccatttaacaaccagatgcgactgctgctggtgaagcgggaatcaggccggccgctctacctgcgcttggtcaccgatcacctgaggctcttcacgctgtatgagcaggtgtctgagagactccggaccctgcctgccactgtccccctgctgctgcagcacatcctgagcacactggagaaggagcacgggcctgatgtccttccccaggccttgactgccctagaagtcacacggagtggtttgactgtggaccagctgcacggagtgctgagtgtgtggcggacactaccgaaggggactaagagctgggaagaagcagtggctgctggtaacagtggagacccctaccccatgggcccgtttgcctgcctcgtccagagtctgcgcagtttgctaggggagggccctctggagcgccctggtgcccggctgtgcctccctgatgggcccctgagaacagcagctaaacgttgctatgggaagaggccagggctagaggacacggcacacatcctcattgcagctcagctctggaagacatgtgacgctgatgcctcaggcaccttccgaagttgccctcctgaggctctgggagacctgccttaccacctgctccagagcgggaaccgtggacttctttcgaagttccttaccaacctccatgtggtggctgcacacttggaattgggtctggtctctcggctcttggaggcccatgccctctatgcttcttcagtccccaaagaggaacaaaagctccccgaggctgacgttgcagtgtttcgcaccttcctgaggcagcaggcttcaatcctcagccagtacccccggctcctgccccagcaggcagccaaccagcccctggactcacctctttgccaccaagcctcgctgctctcccggagatggcacctccaacacacactacgatggcttaataaaccccggaccatgaaaaatcagcaaagctccagcctgtctctggcagtttcctcatcccctactgctgtggccttctccaccaatgggcaaagagcagctgtgggcactgccaatgggacagtttacctgttggacctgagaacttggcaggaggagaagtctgtggtgagtggctgtgatggaatctctgcttgtttgttcctctccgatgatacactctttcttactgccttcgacgggctcctggagctctgggacctgcagcatggttgtcgggtgctgcagactaaggctcaccagtaccaaatcactggctgctgcctgagcccagactgccggctgctagccaccgtgtgcttgggaggatgcctaaagctgtgggacacagtccgtgggcagctggccttccagcacacctaccccaagtccctgaactgtgttgccttccacccagaggggcaggtaatagccacaggcagctgggctggcagcatcagcttcttccaggtggatgggctcaaagtcaccaaggacctgggggcacccggagcctctatccgtaccttggccttcaatgtgcctgggggggttgtggctgtgggccggctggacagtatggtggagctgtgggcctggcgagaaggggcacggctggctgccttccctgcccaccatggctttgttgctgctgcgcttttcctgcatgcgggttgccagttactgacggctggagaggatggcaaggttcaggtgtggtcagggtctctgggtcggccccgtgggcacctgggttccctttctctctctcctgccctctctgtggcactcagcccagatggtgatcgggtggctgttggatatcgagcggatggcattaggatctacaaaatctcttcaggttcccagggggctcagggtcaggcactggatgtggcagtgtccgccctggcctggctaagccccaaggtattggtgagtggtgcagaagatgggtccttgcagggctgggcactcaaggaatgctcccttcagtccctctggctcctgtccagattccagaagcctgtgctaggactggccacttcccaggagctcttggcttctgcctcagaggatttcacagtgcagctgtggccaaggcagctgctgacgcggccacacaaggcagaagactttccctgtggcactgagctgcggggacatgagggccctgtgagctgctgtagtttcagcactgatggaggcagcctggccaccgggggccgggatcggagtctcctctgctgggacgtgaggacacccaaaacccctgttttgatccactccttccctgcctgtcaccgtgactgggtcactggctgtgcctggaccaaagataacctactgatatcctgctccagtgatggctctgtggggctctgggacccagagtcaggacagcggcttggtcagttcctgggtcatcagagtgctgtgagcgctgtggcagctgtggaggagcacgtggtgtctgtgagccgggatgggaccttgaaagtgtgggaccatcaaggcgtggagctgaccagcatccctgctcactcaggacccattagccactgtgcagctgccatggagccccgtgcagctggacagcctgggtcagagcttctggtggtaaccgtcgggctagatggggccacacggttatggcatccactcttggtgtgccaaacccacaccctcctgggacacagcggcccagtccgtgctgctgctgtttcagaaacctcaggcctcatgctgaccgcctctgaggatggttctgtacggctctggcaggttcctaaggaagcagatgacacatgtataccaaggagttctgcagccgtcactgctgtggcttgggcaccagatggttccatggcagtatctggaaatcaagctggggaactaatcttgtggcaggaagctaaggctgtggccacagcacaggctccaggccacattggtgctctgatctggtcctcggcacacaccttttttgtcctcagtgctgatgagaaaatcagcgagtggcaagtgaaactgcggaagggttcggcacccggaaatttgagtcttcacctgaaccgaattctacaggaggacttaggggtgctgacaagtctggattgggctcctgatggtcactttctcatcttggccaaagcagatttgaagttactttgcatgaagccaggggatgctccatctgaaatctggagcagctatacagaaaatcctatgatattgtccacccacaaggagtatggcatatttgtcctgcagcccaaggatcctggagttctttctttcttgaggcaaaaggaatcaggagagtttgaagagaggctgaactttgatataaacttagagaatcctagtaggaccctaatatcgataactcaagccaaacctgaatctgagtcctcatttttgtgtgccagctctgatgggatcctatggaacctggccaaatgcagcccagaaggagaatggaccacaggtaacatgtggcagaaaaaagcaaacactccagaaacccaaactccagggacagacccatctacctgcagggaatctgatgccagcatggatagtgatgccagcatggatagtgagccaacaccacatctaaagacacggcagcgtagaaagattcactcgggctctgtcacagccctccatgtgctacctgagttgctggtgacagcttcgaaggacagagatgttaagctatgggagagacccagtatgcagctgctgggcctgttccgatgcgaagggtcagtgagctgcctggaaccttggctgggcgctaactccaccctgcagcttgccgtgggagacgtgcagggcaatgtgtactttctgaattgggaatga

SEQ ID NO: 7 - RNA, 98 nt, Homo sapiens
ggcuggcuuuagcucagcgguuacuucgacaguucuuuaauugaaacaagcaaccugucuggguuguucgagacccgcgggcgcucuccaguccuuuu

SEQ ID NO: 8 - RNA, 88 nt, Homo sapiens
ggcuggcuuuagcucagcgguuacuucgaguacauuguaaccaccucucugggugguucgagacccgcgggugcuuuccagcucuuuu

SEQ ID NO: 9 - RNA, 88 nt, Homo sapiens
ggcuggcuuuagcucagcgguuacuucgcgugucaucaaaccaccucucuggguuguucgagacccgcgggcgcucuccagcccucuu

SEQ ID NO: 10 - protein, 861 aa, Rattus norvegicus
MATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQK

SEQ ID NO: 11 - DNA, 2586 bp, Rattus norvegicus
atggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatcaacctcttcagcacagccttcgggttgctggggctggggtctgatggtcagccgccagcacagaagtga

SEQ ID NO: 12 - protein, 2629 aa, Rattus norvegicus
MEKLCGYVPVHPDILSLKNRCLTMLSDIQPLEKIHGQRSVNPDILSLENRCLTLLPDLQPMEKIHGQRSVHPDILSSENRCLTLLPDLQSLEKLCGHMSSHPDVLSLENRCLATLPTVKRTVSSGPLLQCLHRSHTAQADLRDPNFRNCLFPEPPTIEAPCFLKELDLPTGPRALKSMSATARVQEVALGQRCVSEGKELQEEKESAEVPMPLYSLSLGGEEEEVVGAPVLKLTSGDSDSHPETTDQILQEKKMALLTLLCSAMASSVNVKDASDPTRASIHEVCSALAPLEPEFILKASLYARQQLNLRDIANIVLAVAALLPACRPHVRRYYSAIVHLPSDWIQVAEFYQSLAEGDEKKLVPLPACLRAAMTDKFAQFDEYQLAKYNPRKHRSKTRSRQPPRPQRTKPPFSESGKCFPKSVWPLKNEQISFEAAYNAVSEKKRLPRFTLKKLVEQLHIHEPAQHVQALLGYRYPSTLELFSRSHLPGPWDSSRAGQRMKLQRPETWERELSLRGNRASVWEELIDNGKLPFMAMLRNLCNLLRTGISAHHHELVLQRLQHEKSVIHSRQFPFRFLNAHDSLDRLEAQLRSKASPFPSNTTLMKRIMIRNSKKIKRPANPRYLCTLTQRQLRAAMAIPVMYEHLKREKLRLHKARQWTCDLELLERYRQALETAVNISVKHNLPPLPGRTLLVYLTDANANRLCPKSHLQGPPLNYVLLLIGMMMARAEQTTVWLCGTGTVKTPVLTADEGILKTAIKLQAQVQELEENDEWPLETFEKYLLSLAVRRTPIDRVILFGQRMDTELLNVAKQIIWQHVNSKCLFVSVLLRKMQYMSPNLNPNDVTLSGCTDGILKFIAEHGASRLLEHVGQLDKIFKIPPPPGKTKVSPLRPLEENNPGPFVPISQHGWRNIRLFISSTFRDMHGERDLLMRSVLPALQARAFPHRISLHAIDLRWGITEEETRRNRQLEVCLGEVENSQLFVGILGSRYGYTPPSYDLPDHPHFHWTQRYPSGRSVTEMEVMQFLNRGQRSEPSDQALIYFRDPGFLSSVPDVWKPDFISESEEAAHRVSELKRFLQEQKEVTCRRYSCEWGGVAAGRPYTGGLEEFGQLVLQDVWSVIQKRYLQPGAQLEQPGSISEEDLIQASFQQLKSPPSPARPRLLQDTVQQLMLPHGRLSLVIGQAGQGKTAFLASLVSALKVPDQPNVAPFVFFHFSAARPDQCLAFNLLRRLCTHLHQKLGEPSALPSTYRGLVWELQQKLLLKSAQWLQPGQTLVLIIDGADKLVDHNGQLISDWIPKSLPRRVHLVLSVSSDSGLGETLQQSQSAYVVALGSLVPSSRAQLVREELALYGKRLEESPFNNQMRLLLAKQGSSLPLYLHLVTDYLRLFTLYEQVSERLRTLPATLPLLLQHILSTLEQEHGHNVLPQALTALEVTHSGLTVDQLHAVLSTWLTLPKETKSWEEAVAASHSGNLYPLAPFAYLVQSLRSLLGEGPVERPGARLCLSDGPLRTAVKRRYGKRLGLEKTAHVLIAAHLWKMCDPDASGTFRSCPPEALKDLPYHLLQSGNHGLLAKFLTNLHVVAAYLEVGLVPDLLEAYELYASSKPEVNQKLPEADVAVFHNFLKQQASLLTQYPLLLLQQAASQPEESPVCCQAPLLTQRWHNQCILKWINKPQTLKGQQSLSLPISSSPTAVAFSPNGQRAAVGTAGGTIYLLNLRTWQEEKALVSGCDGISSFAFLSDTALFLTTFDGLLELWDLQHGCWVFQTKAHQYQITGCCLSPDRRLLATVCLGGYVKLWDTVQGQLAFQYTHPKSLNCITFHPEGQVVATGNWSGIVTFFQADGLKVTKELGGPGPSVRTLAFSAPGKVVALGRIDGTVELWAWQEGTRLAAFPAQCGGVSTVLFLHAGGRFLTAGEDGKAQLWSGFLGRPRGCLGSLYLSPALSVALNPDGDQVAVGYRGDGIKIYRISSGPQEAQCQELNVAVSALVWLSPSVLVSGAEDGSLHGWMLRRNSLQSLWLSSVCQKPVLGLAASQEFLASASEDFTVRLWPRQLLTQPHAVEELPCAAELRGHEGPVCCCSFSPDGRILATAGRDRNLLCWDVKVAQAPLLIHTFSSCHRDWITGCTWTKDNILISCSSDGSVGLWNPEAGQQLGQFPGHQSAVSAVVAVEEHIVSVSRDGTLKVWDRQGVELTSIPAHSGPISQCAAALEPRPAGQPGSELMVVTVGLDGATKLWHPLLVCQIHTLQGHSGPVTAAAASEASGLLLTSDNSSVRLWQIPKEADDTCKPRSSAVITAVAWAPDGSLVVSGNEAGELTLWQKAQAVATARAPGRVSDLIWCSANAFFVLSANENVSEWQVELRKGSTCTNFRLYLKRVLQEDLGVLTGMALAPDGQSLILMKEDVELLQMKPGSTPSSICRRYAVHSSILCTSKDYGLFYLQQGNSGSLSILEQEESGKFEKTLDFNLNLNNPNGSPVSITQAEPESGSSLLCATSDGMLWNLSECTPEGEWVVDNIWQKKSRNPKSRTPGTDSSPGLFCMDSWVEPTHLKARQCKKIHLGSVTALHVLPGLLVTASEDRDVKLWERPSMQLLGLFRCEGPVSCLEPWMEPSSPLQLAVGDAQGNLYFLSWE

SEQ ID NO: 13 - DNA, 7890 bp, Rattus norvegicus
atggagaaactctgtggttatgtgcctgtccacccagacatcctctccttgaagaatcggtgcctgaccatgctctctgacatccaacccctggagaaaatacatggacagagatctgtcaacccagacatcctgtccttggagaaccggtgcctgaccttgctccctgatctccagcccatggagaaaatacatggacagagatctgtccacccagacatcctctcctcagagaaccggtgtctgaccttgctccctgacctccagtccctggagaagctatgtggacatatgtctagtcacccagacgtcctctctttggagaaccgatgtcttgctaccctcccgactgtaaagagaactgtttcgagtggccccttgctccagtgtcttcacagatctcatacggcacaagctgatctgcgtgacccgaactttcgcaactgcctgttccctgagcctcctaccatagaggctccatgtttcttgaaggaactagaccttccaactggacccagggccctgaaatccatgtctgctacagctcgagttcaggaagtagctttgggtcagcggtgcgtctcagaaggaaaggaattgcaggaagaaaaagaaagcgcagaagtcccgatgcctttgtacagtctaagcttggggggagaagaagaagaagtggtgggggcaccggtcctaaaactcacatctggagactctgactctcaccctgaaaccactgaccagatcctgcaggagaagaagatggctctcttgaccttgctgtgctcagctatggcctcaagtgtgaatgtgaaagatgcctccgatcctacccgggcatctatccatgaagtctgcagtgcgctggcccccttggaacctgagttcatccttaaggcatctttgtatgctaggcagcagcttaacctccgggacatagccaatatagtgttggccgtggctgccctcttgccagcctgccgcccccatgtacgacggtattactctgccattgttcacctgccttcagactggatccaggtagccgagttctaccagagcctggcagaaggggatgagaagaagttggtgcccctgcctgcctgcctccgtgctgccatgactgacaaatttgcccagtttgatgagtaccagctagcgaagtacaacccacggaaacaccgatccaagacacgttcccgccagccaccccgccctcaaaggacaaaacctccattttcagagagtgggaaatgttttccaaagagcgtttggccccttaaaaacgaacagatttcgttcgaagcagcttataatgcagtgtcagagaagaaaaggctaccaaggttcactctgaagaagttggtagagcaactgcatatccatgagcctgcgcagcatgtccaggccctgctgggctacaggtacccatccaccctagagctcttttctcggagtcatctccctgggccatgggactctagcagggctgggcaacggatgaagctccaaaggccagagacctgggagcgggagctgagcttacgtggaaacagagcttctgtgtgggaggaactcatagacaatgggaaactccccttcatggccatgctccggaacctgtgtaacctgctgcggactgggatcagtgcccaccaccatgaactcgttctccagagactccagcatgagaaatctgtgattcacagtcggcagtttccattcagattccttaatgctcacgactctctcgatagactcgaggctcagctcagaagtaaagcatcgcccttcccttccaatacaacattgatgaagcggataatgattagaaactcaaaaaaaatcaagagacctgccaacccgaggtacctgtgcaccctgacgcagcggcagcttcgggcggcaatggctatcccggtgatgtatgagcatctcaagcgggagaaactgaggctgcacaaggccagacagtggacctgtgaccttgagttgctggagcggtatcgccaggccctggaaacggccgtgaacatctctgtaaagcacaacctacccccgctgccaggccgaaccctcttggtctatctcacagatgcaaatgccaacagactttgtcccaagagtcacttgcaagggcctcccctgaactatgtgctgctgttgatcgggatgatgatggctcgggcggagcagacgacagtttggctgtgtgggacaggaactgtgaagacaccagtacttacagccgacgaaggtatcctgaagactgccatcaaacttcaggctcaagtccaggagttagaagaaaatgatgagtggcccctggaaacttttgagaagtacctgctatctctggctgtgcgaaggacccctattgacagggtcatcctgttcggccaaaggatggatacggagctgctgaatgtagccaaacagattatctggcagcatgtgaattccaagtgcctcttcgtcagtgtcctcctacggaaaatgcagtacatgtcaccaaatttgaatcccaatgatgtgacgctctcgggctgcactgacgggatcctgaagttcattgcggagcatggagcctctcgtcttctggaacatgtgggccaactagataagatattcaagatccctccacccccaggaaagacaaaggtctcacctctccggccgctggaggagaacaaccctggtcccttcgttcctatttcccagcatggatggcgcaacatccggcttttcatttcgtccactttccgagacatgcatggggaacgagacttgctgatgcgatctgttctgccagcgctgcaggcccgagcgttcccccaccgcatcagccttcacgccattgacctgcgctggggaatcacggaggaagagacccgcaggaacagacaactggaagtgtgccttggggaggtggagaactctcagctgttcgtggggatcctgggctcccgctatggctatactccccccagctatgatctgcctgaccacccccactttcactggacccagcgatacccttcggggcgctctgtaacagagatggaggtgatgcagttcctgaaccgtggccaacgctcggaaccctctgaccaagctctcatctacttccgagatcctggtttccttagctctgtgccagatgtctggaaacctgactttatttccgagtcagaagaggctgcacatcgggtctcagaactgaagagattcctacaggaacagaaagaggttacctgccgcaggtactcctgtgaatggggaggcgtagcagccggccggccctatactgggggcctggaggagtttggacagttggttctccaagatgtgtggagcgtgatccagaagcgttacctgcagcctggggcccagttggagcagccaggatccatctcagaagaggatttgatccaggccagctttcagcagctgaagagcccaccgagtcccgcacggccacgccttcttcaggataccgtgcaacagctgatgctgccccacgggaggctgagcctagtgattgggcaggcaggacagggaaagactgccttcctggcatcccttgtgtcggccctgaaggttcccgaccagcccaatgtggccccgttcgttttcttccacttttcagcagcccgccctgaccagtgtcttgctttcaacctcctcagacgcctctgtacccatctgcatcaaaaactgggagagccgagcgctctccccagcacttacagaggcctggtgtgggaactgcagcagaagctgctcctcaaatctgcccagtggctgcaaccaggccagactttggtccttattatcgacggggcagataagttggtggaccataatggacagctgatttcagactggatccccaagtctcttccgcggcgagtacacctggtgctgagtgtgtctagtgactcaggcctgggagagacccttcagcaaagtcagagtgcttatgtggtggccttggggtctttggtcccgtcttcaagggctcagcttgtgagagaagagctagcactgtatgggaaacggctggaggagtcaccttttaacaaccagatgcggctgctgctggcaaagcaggggtcaagcctgccactgtacctgcacctcgtcactgactacctgaggcttttcacactgtacgaacaggtgtctgagagacttcgaaccctgcccgccactctcccactgctgctgcagcacatcctgagcaccttggagcaagagcatggccataacgtccttcctcaagctttgactgcccttgaggtcacgcacagtggtctgactgtggaccagctgcatgcagtcctgagcacgtggttgactttgcccaaggagactaagagctgggaagaggcagtggctgccagtcacagtggaaacctctaccccttggctccatttgcctaccttgtccagagtctacgcagtttactaggcgagggccccgtggagcgccctggcgcccgtctctgcctctctgatgggcctctgaggacagcagttaaacgtcgctatgggaaaaggctggggctagagaagactgcgcatgtcctcattgcagctcacctctggaagatgtgtgaccctgatgcctcaggcaccttccgaagttgccctcccgaggctctgaaagatttaccttaccacctgctccagagcgggaaccatggtctccttgcaaagttccttaccaacctccatgtggtggctgcatatctggaagtgggtctagtcccggacctcttggaggcttacgagctctatgcttcttcaaagcctgaagtgaaccagaagctcccggaggcagatgttgctgtattccacaacttcctgaaacaacaggcttcactccttacccagtatcctttgctcctgctccagcaggcagctagccagcctgaagagtcacctgtttgctgccaggcccccctgctcacccagcggtggcacaaccagtgcatactgaaatggattaataaaccccagaccttgaagggtcagcaaagcttgtctctgccaatttcctcatccccaactgctgtggccttctctcctaatgggcaaagagcagctgtggggactgctggtgggacaatttacctgttgaacttgagaacctggcaggaggagaaggctctggtgagtggctgtgatgggatttcctctttcgcgttcctgtcagacactgctcttttccttaccaccttcgatgggctcctggagctttgggacctgcaacatggttgttgggtgttccagaccaaggcccaccagtaccaaatcactggctgctgcctgagcccagaccgccgcctgctggccaccgtgtgtttgggaggatacgtaaagctgtgggacacagtccagggccagctggctttccagtacacccatcccaagtctctaaactgcatcaccttccacccagaggggcaggtggtagccacaggcaactggtctggcatcgtgaccttcttccaggcagatggactcaaagtcaccaaggaactagggggcccaggaccctctgttcgtacgctggcattcagtgcacccgggaaggttgtggctctaggccggatagatgggacagtggagctgtgggcctggcaagagggcacacggctggcagccttccctgcacagtgtggcggtgtctccaccgttcttttcttgcatgctggaggccggttcctgacggctggggaagatggcaaggctcagttatggtcaggatttcttggccggcccaggggttgcctgggctctctttatctttctcctgcgctctctgtggctctcaacccagacggtgaccaggtggctgttgggtaccgaggagatggcattaaaatctacagaatttcttcaggtccccaggaggctcaatgccaagagctaaatgtggcggtgtctgcactggtctggctgagtcccagcgtcttggtgagtggtgcagaagatggctccctgcatggctggatgctcaggagaaactcccttcagtccctgtggctgtcatccgtgtgccagaagcctgtgctggggctggctgcctcccaggagttcttggcttctgcctcagaggacttcacggtgcgactgtggccaagacagctgctgacacagccacatgcagtagaagagttgccctgtgcggctgaactccggggacacgaggggccggtgtgctgctgtagcttcagcccggatggacgcatcttggccacagcgggcagggatcggaatctcctctgctgggacgtcaaggtagcccaagcccctctcctgattcacacgttctcgtcctgtcatcgagactggatcactggctgtacgtggaccaaagacaacatcctgatctcctgctctagtgatggctctgtgggactctggaacccagaggcaggacagcaacttggccagttcccaggtcaccagagtgccgtgagcgctgtggttgctgtggaggaacacattgtatctgtgagtcgggatgggaccttgaaagtgtgggaccgtcagggtgtggagctgaccagcatccctgcccattccggacccattagccagtgtgcggctgctctggaaccccgtccagctggacagcctggatcagagcttatggtggtgactgttggactggatggggccacaaagctgtggcatcccctgttggtgtgccaaatacataccctgcagggacacagtggtccagtcacagctgctgctgcttcagaggcctcaggcctcctgctgacctcagacaatagctctgtacgactctggcagatccctaaggaagcagatgatacctgcaaacctaggagttctgcggtcatcaccgctgtggcgtgggcaccagatggttctctggtggtgtctggaaatgaagctggggaactaacgctgtggcagaaagcgcaggctgtggctacggcacgggctccaggccgcgtcagtgacctgatctggtgctccgcaaatgcattctttgttctcagtgctaatgaaaatgtcagtgagtggcaagtggaactgaggaaaggttcaacatgcaccaatttcagactttatctgaagagagttctgcaggaggacttgggagtcttgacaggtatggccctggcgcctgacggccagtctctcattttgatgaaagaggatgtagaattgctacagatgaagcccgggtctactccatcttcgatctgcaggaggtatgcagtgcattcttctatactgtgcaccagcaaagactatggcctgttttacctgcagcagggaaactctggatctctttctatcttggagcaggaggagtcagggaagtttgaaaagaccctggacttcaatctgaacttaaataatcctaatgggtccccagtatcaatcactcaggctgaacctgagtctgggtcctcgcttttgtgtgctacctctgatgggatgctgtggaacttatctgagtgtaccccagaaggagagtgggtcgtagataacatctggcagaaaaaatcaagaaaccctaaaagtcgaactccggggacagattcgtccccaggcttattctgcatggatagctgggtagaacccacacatttaaaggcacggcagtgtaaaaagattcacttgggctctgtcacggccctccatgtgctgcccggattgctggtgactgcttcagaggacagagatgttaagctgtgggagagacccagtatgcagctgctcggcttgttccgatgtgaagggccggtgagctgtctggaaccttggatggagcccagctctcccctgcagcttgctgtgggagatgcacaaggaaacttgtattttctatcttgggaatga

SEQ ID NO: 14 - RNA, 143 nt, Rattus norvegicus
ggccagcuuuagcucagcgguuacuucgacgugcuccaguuugagcaggcuauguaacguggucgguucgagcaacacaaccagccgcuugccuaucuggugagugguugguucgagacccgcgggcgcucucuggcccuuuu

SEQ ID NO: 15 - protein, 12 aa, Artificial Sequence
  Description of Artificial Sequence: Synthetic peptide
MAGCGCPCGCGA

SEQ ID NO: 16 - protein, 905 aa, Artificial Sequence
  Description of Artificial Sequence: Synthetic and Homo sapiens polypeptide
MAGCGCPCGCGAMATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLR

SEQ ID NO: 17 - DNA, 2718 bp, Artificial Sequence
  Description of Artificial Sequence: Synthetic and Homo sapiens polynucleotide
atggcaggctgcggttgtccatgcggttgtggcgccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaa

SEQ ID NO: 18 - protein, 873 aa, Artificial Sequence
  Description of Artificial Sequence: Synthetic and Rattus norvegicus polypeptide
MAGCGCPCGCGAMATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQK

SEQ ID NO: 19 - DNA, 2622 bp, Artificial Sequence
  Description of Artificial Sequence: Synthetic and Rattus norvegicus polynucleotide
atggcaggctgcggttgtccatgcggttgtggcgccatggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatcaacctcttcagcacagccttcgggttgctggggctggggtctgatggtcagccgccagcacagaagtga

SEQ ID NO: 20 - protein, 31 aa, Artificial Sequence
  Description of Artificial Sequence: Synthetic polypeptide
MGSSHHHHHHSSGLVPRGSHMASMTGGQQPW

SEQ ID NO: 21 - DNA, 89 bp, Artificial Sequence
  Description of Artificial Sequence: Synthetic oligonucleotide
atgggcagcagccatcatcatcatcatcacagcagcggcctggtgccgcgcggcagccatatggctagcatgactggtggacagcaacc

SEQ ID NO: 22 - protein, 17 aa, Artificial Sequence
  Description of Artificial Sequence: Synthetic peptide
MKKKKKKKKKKKKKKKP

SEQ ID NO: 23 - DNA, 51 bp, Artificial Sequence
  Description of Artificial Sequence: Synthetic oligonucleotide
atgaagaagaagaagaagaagaagaagaagaagaagaagaagaagaagccc

SEQ ID NO: 24 - protein, 923 aa, Artificial Sequence
  Description of Artificial Sequence: Synthetic and Homo sapiens polypeptide
MGSSHHHHHHSSGLVPRGSHMASMTGGQQPMATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLR

SEQ ID NO: 25 - DNA, 2772 bp, Artificial Sequence
  Description of Artificial Sequence: Synthetic and Homo sapiens polynucleotide
atgggcagcagccatcatcatcatcatcacagcagcggcctggtgccgcgcggcagccatatggctagcatgactggtggacagcaacccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaa

SEQ ID NO: 26 - protein, 910 aa, Artificial Sequence
  Description of Artificial Sequence: Synthetic and Homo sapiens polypeptide
MKKKKKKKKKKKKKKKPMATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLR

SEQ ID NO: 27 - DNA, 2733 bp, Artificial Sequence
  Description of Artificial Sequence: Synthetic and Homo sapiens polynucleotide
atgaagaagaagaagaagaagaagaagaagaagaagaagaagaagaagcccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaa

SEQ ID NO: 28 - protein, 892 aa, Artificial Sequence
  Description of Artificial Sequence: Synthetic and Rattus norvegicus polypeptide
MGSSHHHHHHSSGLVPRGSHMASMTGGQQPWMATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQK

SEQ ID NO: 29 - DNA, 2679 bp, Artificial Sequence
  Description of Artificial Sequence: Synthetic and Rattus norvegicus polynucleotide
atgggcagcagccatcatcatcatcatcacagcagcggcctggtgccgcgcggcagccatatggctagcatgactggtggacagcaaccatggatggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatcaacctcttcagcacagccttcgggttgctggggctggggtctgatggtcagccgccagcacagaagtga

SEQ ID NO: 30 - protein, 878 aa, Artificial Sequence
  Description of Artificial Sequence: Synthetic and Rattus norvegicus polypeptide
MKKKKKKKKKKKKKKKPMATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQK

SEQ ID NO: 31 - DNA, 2637 bp, Artificial Sequence
  Description of Artificial Sequence: Synthetic and Rattus norvegicus polynucleotide
atgaagaagaagaagaagaagaagaagaagaagaagaagaagaagaagcccatggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatcaacctcttcagcacagccttcgggttgctggggctggggtctgatggtcagccgccagcacagaagtga

SEQ ID NO: 32 - protein, 96 aa, Saccharomyces cerevisiae
MKLLSSIEQACDICRLKKLKCSKEKPKCAKCLKNNWECRYSPKTKRSPLTRAHLTEVESRLERLEQLFLLIFPREDLDMILKMDSLQDIKALLTGL

SEQ ID NO: 33 - DNA, 288 bp, Saccharomyces cerevisiae
atgaagctactgtcttctatcgaacaagcatgcgatatttgccgacttaaaaagctcaagtgctccaaagaaaaaccgaagtgcgccaagtgtctgaagaacaactgggagtgtcgctactctcccaaaaccaaaaggtctccgctgactagggcacatctgacagaagtggaatcaaggctagaaagactggaacagctatttctactgatttttcctcgagaagaccttgacatgattttgaaaatggattctttacaggatataaaagcattgttaacaggatta

SEQ ID NO: 34 - protein, 989 aa, Artificial Sequence
  Description of Artificial Sequence: Synthetic Saccharomyces cerevisiae and Homo sapiens polypeptide
MKLLSSIEQACDICRLKKLKCSKEKPKCAKCLKNNWECRYSPKTKRSPLTRAHLTEVESRLERLEQLFLLIFPREDLDMILKMDSLQDIKALLTGLMATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLR

SEQ ID NO: 35 - DNA, 2970 bp, Artificial Sequence
  Description of Artificial Sequence: Synthetic Saccharomyces cerevisiae and Homo sapiens polynucleotide
atgaagctactgtcttctatcgaacaagcatgcgatatttgccgacttaaaaagctcaagtgctccaaagaaaaaccgaagtgcgccaagtgtctgaagaacaactgggagtgtcgctactctcccaaaaccaaaaggtctccgctgactagggcacatctgacagaagtggaatcaaggctagaaagactggaacagctatttctactgatttttcctcgagaagaccttgacatgattttgaaaatggattctttacaggatataaaagcattgttaacaggattaatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaa

SEQ ID NO: 36 - protein, 957 aa, Artificial Sequence
  Description of Artificial Sequence: Synthetic Saccharomyces cerevisiae and Rattus norvegicus polypeptide
MKLLSSIEQACDICRLKKLKCSKEKPKCAKCLKNNWECRYSPKTKRSPLTRAHLTEVESRLERLEQLFLLIFPREDLDMILKMDSLQDIKALLTGLMATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQK

SEQ ID NO: 37 - DNA, 2874 bp, Artificial Sequence
  Description of Artificial Sequence: Synthetic Saccharomyces cerevisiae and Rattus norvegicus polynucleotide
atgaagctactgtcttctatcgaacaagcatgcgatatttgccgacttaaaaagctcaagtgctccaaagaaaaaccgaagtgcgccaagtgtctgaagaacaactgggagtgtcgctactctcccaaaaccaaaaggtctccgctgactagggcacatctgacagaagtggaatcaaggctagaaagactggaacagctatttctactgatttttcctcgagaagaccttgacatgattttgaaaatggattctttacaggatataaaagcattgttaacaggattaatggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatcaacctcttcagcacagccttcgggttgctggggctggggtctgatggtcagccgccagcacagaagtga

SEQ ID NO: 38 - protein, 130 aa, Levivirus
MASNFTQFVLVDNGGTGDVTVAPSNFANGVAEWISSNSRSQAYKVTCSVRQSSAQNRKYTIKVEVPKVATQTVGGVELPVAAWRSYLNMELTIPIFATNSDCELIVKAMQGLLKDGNPIPSAIAANSGIY

SEQ ID NO: 39 - DNA, 393 bp, Levivirus
atggcttctaactttactcagttcgttctcgtcgacaatggcggaactggcgacgtgactgtcgccccaagcaacttcgctaacggggtcgctgaatggatcagctctaactcgcgttcacaggcttacaaagtaacctgtagcgttcgtcagagctctgcgcagaatcgcaaatacaccatcaaagtcgaggtgcctaaagtggcaacccagactgttggtggtgtagagcttcctgtagccgcatggcgttcgtacttaaatatggaactaaccattccaattttcgctacgaattccgactgcgagcttattgttaaggcaatgcaaggtctcctaaaagatggaaacccgattccctcagcaatcgcagcaaactccggcatctacccc

SEQ ID NO: 40 - protein, 1024 aa, Artificial Sequence
  Description of Artificial Sequence: Synthetic Levivirus and Homo sapiens polypeptide
MASNFTQFVLVDNGGTGDVTVAPSNFANGVAEWISSNSRSQAYKVTCSVRQSSAQNRKYTIKVEVPKVATQTVGGVELPVAAWRSYLNMELTIPIFATNSDCELIVKAMQGLLKDGNPIPSAIAANSGIYPMATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLR

SEQ ID NO: 41 - DNA, 3075 bp, Artificial Sequence
  Description of Artificial Sequence: Synthetic Levivirus and Homo sapiens polynucleotide
atggcttctaactttactcagttcgttctcgtcgacaatggcggaactggcgacgtgactgtcgccccaagcaacttcgctaacggggtcgctgaatggatcagctctaactcgcgttcacaggcttacaaagtaacctgtagcgttcgtcagagctctgcgcagaatcgcaaatacaccatcaaagtcgaggtgcctaaagtggcaacccagactgttggtggtgtagagcttcctgtagccgcatggcgttcgtacttaaatatggaactaaccattccaattttcgctacgaattccgactgcgagcttattgttaaggcaatgcaaggtctcctaaaagatggaaacccgattccctcagcaatcgcagcaaactccggcatctaccccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaa

SEQ ID NO: 42 - protein, 992 aa, Artificial Sequence
  Description of Artificial Sequence: Synthetic Levivirus and Rattus norvegicus polypeptide
MASNFTQFVLVDNGGTGDVTVAPSNFANGVAEWISSNSRSQAYKVTCSVRQSSAQNRKYTIKVEVPKVATQTVGGVELPVAAWRSYLNMELTIPIFATNSDCELIVKAMQGLLKDGNPIPSAIAANSGIYPMATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQK

SEQ ID NO: 43 - DNA, 2979 bp, Artificial Sequence
  Description of Artificial Sequence: Synthetic Levivirus and Rattus norvegicus polynucleotide
atggcttctaactttactcagttcgttctcgtcgacaatggcggaactggcgacgtgactgtcgccccaagcaacttcgctaacggggtcgctgaatggatcagctctaactcgcgttcacaggcttacaaagtaacctgtagcgttcgtcagagctctgcgcagaatcgcaaatacaccatcaaagtcgaggtgcctaaagtggcaacccagactgttggtggtgtagagcttcctgtagccgcatggcgttcgtacttaaatatggaactaaccattccaattttcgctacgaattccgactgcgagcttattgttaaggcaatgcaaggtctcctaaaagatggaaacccgattccctcagcaatcgcagcaaactccggcatctaccccatggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatcaacctcttcagcacagccttcgggttgctggggctggggtctgatggtcagccgccagcacagaagtga

SEQ ID NO: 44 - protein, 239 aa, Artificial Sequence
  Description of Artificial Sequence: Synthetic polypeptide
MSKGEELFTGVVPILVELDGDVNGHKFSVSGEGEGDATYGKLTLKFICTTGKLPVPWPTLVTTFTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITHGMDELYKP

SEQ ID NO: 45 - DNA, 720 bp, Artificial Sequence
  Description of Artificial Sequence: Synthetic polynucleotide
atgagcaagggcgaggaactgttcactggcgtggtcccaattctcgtggaactggatggcgatgtgaatgggcacaaattttctgtcagcggagagggtgaaggtgatgccacatacggaaagctcaccctgaaattcatctgcaccactggaaagctccctgtgccatggccaacactggtcactaccttcacctatggcgtgcagtgcttttccagatacccagaccatatgaagcagcatgactttttcaagagcgccatgcccgagggctatgtgcaggagagaaccatctttttcaaagatgacgggaactacaagacccgcgctgaagtcaagttcgaaggtgacaccctggtgaatagaatcgagctgaagggcattgactttaaggaggatggaaacattctcggccacaagctggaatacaactataactcccacaatgtgtacatcatggccgacaagcaaaagaatggcatcaaggtcaacttcaagatcagacacaacattgaggatggatccgtgcagctggccgaccattatcaacagaacactccaatcggcgacggccctgtgctcctcccagacaaccattacctgtccacccagtctgccctgtctaaagatcccaacgaaaagagagaccacatggtcctgctggagtttgtgaccgctgctgggatcacacatggcatggacgagctgtacaagcccatg

SEQ ID NO: 46 - protein, 1132 aa, Artificial Sequence [sequence omitted]

SEQ ID NO: 47 - DNA, 3399 bp, Artificial Sequence
  Description of Artificial Sequence: Synthetic and Homo sapiens polynucleotide
atgagcaagggcgaggaactgttcactggcgtggtcccaattctcgtggaactggatggcgatgtgaatgggcacaaattttctgtcagcggagagggtgaaggtgatgccacatacggaaagctcaccctgaaattcatctgcaccactggaaagctccctgtgccatggccaacactggtcactaccttcacctatggcgtgcagtgcttttccagatacccagaccatatgaagcagcatgactttttcaagagcgccatgcccgagggctatgtgcaggagagaaccatctttttcaaagatgacgggaactacaagacccgcgctgaagtcaagttcgaaggtgacaccctggtgaatagaatcgagctgaagggcattgactttaaggaggatggaaacattctcggccacaagctggaatacaactataactcccacaatgtgtacatcatggccgacaagcaaaagaatggcatcaaggtcaacttcaagatcagacacaacattgaggatggatccgtgcagctggccgaccattatcaacagaacactccaatcggcgacggccctgtgctcctcccagacaaccattacctgtccacccagtctgccctgtctaaagatcccaacgaaaagagagaccacatggtcctgctggagtttgtgaccgctgctgggatcacacatggcatggacgagctgtacaagcccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaa

SEQ ID NO: 48 - protein, 1100 aa, Artificial Sequence
  Description of Artificial Sequence: Synthetic and Rattus norvegicus polypeptide
MSKGEELFTGVVPILVELDGDVNGHKFSVSGEGEGDATYGKLTLKFICTTGKLPVPWPTLVTTFTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITHGMDELYKPMATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQK

SEQ ID NO: 49 - DNA, 3303 bp, Artificial Sequence
  Description of Artificial Sequence: Synthetic and Rattus norvegicus polynucleotide
atgagcaagggcgaggaactgttcactggcgtggtcccaattctcgtggaactggatggcgatgtgaatgggcacaaattttctgtcagcggagagggtgaaggtgatgccacatacggaaagctcaccctgaaattcatctgcaccactggaaagctccctgtgccatggccaacactggtcactaccttcacctatggcgtgcagtgcttttccagatacccagaccatatgaagcagcatgactttttcaagagcgccatgcccgagggctatgtgcaggagagaaccatctttttcaaagatgacgggaactacaagacccgcgctgaagtcaagttcgaaggtgacaccctggtgaatagaatcgagctgaagggcattgactttaaggaggatggaaacattctcggccacaagctggaatacaactataactcccacaatgtgtacatcatggccgacaagcaaaagaatggcatcaaggtcaacttcaagatcagacacaacattgaggatggatccgtgcagctggccgaccattatcaacagaacactccaatcggcgacggccctgtgctcctcccagacaaccattacctgtccacccagtctgccctgtctaaagatcccaacgaaaagagagaccacatggtcctgctggagtttgtgaccgctgctgggatcacacatggcatggacgagctgtacaagcccatggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatcaacctcttcagcacagccttcgggttgctggggctggggtctgatggtcagccgccagcacagaagtga

SEQ ID NO: 50 - protein, 267 aa, Artificial Sequence
  Description of Artificial Sequence: Synthetic and Homo sapiens polypeptide
MAGCGCPCGCGAGIPANLRLPMASALPEALCSQSRTTPVDLCLLEESVGSLEGSRCPVFAFQSSDTESDELSEVLQDSCFLQIKCDTKDDSIPCFLELKEEDEIVCTQHWQDAVPWTELLSLQTEDGFWKLTPELGLILNLNTNGLHSFLKQKGIQSLGVKGRECLLDLIATMLVLQFIRTRLEKEGIVFKSLMKMDDPSISRNIPWAFEAIKQASEWVRRTEGQYPSICPRLELGNDWDSATKQLLGLQPISTVSPLHRVLHYSQG

SEQ ID NO: 51 - DNA, 804 bp, Artificial Sequence
  Description of Artificial Sequence: Synthetic and Homo sapiens polynucleotide
atggcaggctgcggttgtccatgcggttgtggcgccggaattcctgccaaccttaggctgccaatggcctctgctttacctgaggctctttgcagtcagtcccggactaccccagtagatctctgtcttctagaagaatcagtaggcagtctcgaaggaagtcgatgtcctgtctttgcttttcaaagttctgacacagaaagtgatgagctatcagaagtacttcaagacagctgctttttacaaataaagtgtgatacaaaagatgacagtatcccgtgctttctggaattaaaagaagaggatgaaatagtgtgcacacaacactggcaggatgctgtgccttggacagaactcctcagtctacagacagaggatggcttctggaaacttacaccagaactgggacttatattaaatcttaatacaaatggtttgcacagctttcttaaacaaaaaggcattcaatctctaggtgtaaaaggaagagaatgtctcctggacctaattgccacaatgctggtactacagtttattcgcaccaggttggaaaaagagggaatagtgttcaaatcactgatgaaaatggatgacccttctatttccaggaatattccctgggcttttgaggcaataaagcaagcaagtgaatgggtaagaagaactgaaggacagtacccatctatctgcccacggcttgaactggggaacgactgggactctgccaccaagcagttgctgggactccagcccataagcactgtgtcccctcttcatagagtcctccattacagtcaaggctaa

SEQ ID NO: 52 - protein, 1736 aa, Artificial Sequence
  Description of Artificial Sequence: Synthetic and Homo sapiens polypeptide
MAGCGCPCGCGAMVMGIFANCIFCLKVKYLPQQQKKKLQTDIKENGGKFSFSLNPQCTHIILDNADVLSQYQLNSIQKNHVHIANPDFIWKSIREKRLLDVKNYDPYKPLDITPPPDQKASSSEVKTEGLCPDSATEEEDTVELTEFGMQNVEIPHLPQDFEVAKYNTLEKVGMEGGQEAVVVELQCSRDSRDCPFLISSHFLLDDGMETRRQFAIKKTSEDASEYFENYIEELKKQGFLLREHFTPEATQLASEQLQALLLEEVMNSSTLSQEVSDLVEMIWAEALGHLEHMLLKPVNRISLNDVSKAEGILLLVKAALKNGETAEQLQKMMTEFYRLIPHKGTMPKEVNLGLLAKKADLCQLIRDMVNVCETNLSKPNPPSLAKYRALRCKIEHVEQNTEEFLRVRKEVLQNHHSKSPVDVLQIFRVGRVNETTEFLSKLGNVRPLLHGSPVQNIVGILCRGLLLPKVVEDRGVQRTDVGNLGSGIYFSDSLSTSIKYSHPGETDGTRLLLICDVALGKCMDLHEKDFPLTEAPPGYDSVHGVSQTASVTTDFEDDEFVVYKTNQVKMKYIIKFSMPGDQIKDFHPSDHTELEEYRPEFSNFSKVEDYQLPDAKTSSSTKAGLQDASGNLVPLEDVHIKGRIIDTVAQVIVFQTYTNKSHVPIEAKYIFPLDDKAAVCGFEAFINGKHIVGEIKEKEEAQQEYLEAVTQGHGAYLMSQDAPDVFTVSVGNLPPKAKVLIKITYITELSILGTVGVFFMPATVAPWQQDKALNENLQDTVEKICIKEIGTKQSFSLTMSIEMPYVIEFIFSDTHELKQKRTDCKAVISTMEGSSLDSSGFSLHIGLSAAYLPRMWVEKHPEKESEACMLVFQPDLDVDLPDLASESEVIICLDCSSSMEGVTFLQAKQITLHALSLVGEKQKVNIIQFGTGYKELFSYPKHITSNTTAAEFIMSATPTMGNTDFWKTLRYLSLLYPARGSRNILLVSDGHLQDESLTLQLVKRSRPHTRLFACGIGSTANRHVLRILSQCGAGVFEYFNAKSKHSWRKQIEDQMTRLCSPSCHSVSVKWQQLNPDAPEALQAPAQVPSLFRNDRLLVYGFIPHCTQATLCALIQEKEFCTMVSTTELQKTTGTMIHKLAARALIRDYEDGILHENETSHEMKKQTLKSLIIKLSKENSLITQFTSFVAVEKRDENESPFPDIPKVSELIAKEDVDFLPYMSWQGEPQEAVRNQSLLASSEWPELRLSKRKHRKIPFSKRKMELSQPEVSEDFEEDGLGVLPAFTSNLERGGVEKLLDLSWTESCKPTATEPLFKKVSPWETSTSSFFPILAPAVGSYLTPTTRAHSPASLSFASYRQVASFGSAAPPRQFDASQFSQGPVPGTCADWIPQSASCPTGPPQNPPSAPYCGIVFSGSSLSSAQSAPLQHPGGFTTRPSAGTFPELDSPQLHFSLPTDPDPIRGFGSYHPSAYSPFHFQPSAASLTANLRLPMASALPEALCSQSRTTPVDLCLLEESVGSLEGSRCPVFAFQSSDTESDELSEVLQDSCFLQIKCDTKDDSIPCFLELKEEDEIVCTQHWQDAVPWTELLSLQTEDGFWKLTPELGLILNLNTNGLHSFLKQKGIQSLGVKGRECLLDLIATMLVLQFIRTRLEKEGIVFKSLMKMDDPSISRNIPWAFEAIKQASEWVRRTEGQYPSICPRLELGNDWDSATKQLLGLQPISTVSPLHRVLHYSQG

SEQ ID NO: 53 - DNA, 5211 bp, Artificial Sequence
  Description of Artificial Sequence: Synthetic and Homo sapiens polynucleotide
atggcaggctgcggttgtccatgcggttgtggcgccatggtgatgggaatctttgcaaattgtatcttctgtttgaaagtgaagtacttacctcagcagcagaagaaaaagctacaaactgacattaaggaaaatggcggaaagttttccttttcgttaaatcctcagtgcacacatataatcttagataatgctgatgttctgagtcagtaccaactgaattctatccaaaagaaccacgttcatattgcaaacccagattttatatggaaatctatcagagaaaagagactcttggatgtaaagaattatgatccttataagcccctggacatcacaccacctcctgatcagaaggcgagcagttctgaagtgaaaacagaaggtctatgcccggacagtgccacagaggaggaagacactgtggaactcactgagtttggtatgcagaatgttgaaattcctcatcttcctcaagattttgaagttgcaaaatataacaccttggagaaagtgggaatggagggaggccaggaagctgtggtggtggagcttcagtgttcgcgggactccagggactgtcctttcctgatatcctcacacttcctcctggatgatggcatggagactagaagacagtttgctataaagaaaacctctgaagatgcaagtgaatactttgaaaattacattgaagaactgaagaaacaaggatttctactaagagaacatttcacacctgaagcaacccaattagcatctgaacaattgcaagcattgcttttggaggaagtcatgaattcaagcactctgagccaagaggtgagcgatttagtagagatgatttgggcagaggccctgggccacctggaacacatgcttctcaagccagtgaacaggattagcctcaacgatgtgagcaaggcagaggggattctccttctagtaaaggcagcactgaaaaatggagaaacagcagagcaattgcaaaagatgatgacagagttttacagactgatacctcacaaaggcacaatgcccaaagaagtgaacctgggactattggctaagaaagcagacctctgccagctaataagagacatggttaatgtctgtgaaactaatttgtccaaacccaacccaccatccctggccaaataccgagctttgaggtgcaaaattgagcatgttgaacagaatactgaagaatttctcagggttagaaaagaggttttgcagaatcatcacagtaagagcccagtggatgtcttgcagatatttagagttggcagagtgaatgaaaccacagagtttttgagcaaacttggtaatgtgaggcccttgttgcatggttctcctgtacaaaacatcgtgggaatcttgtgtcgagggttgcttttacccaaagtagtggaagatcgtggtgtgcaaagaacagacgtcggaaaccttggaagtgggatttatttcagtgattcgctcagtacaagtatcaagtactcacacccgggagagacagatggcaccagactcctgctcatttgtgacgtagccctcggaaagtgtatggacttacatgagaaggactttcccttaactgaagcaccaccaggctacgacagtgtgcatggagtttcacaaacagcctctgtcaccacagactttgaggatgatgaatttgttgtctataaaaccaatcaggttaaaatgaaatatattattaaattttccatgcctggagatcagataaaggactttcatcctagtgatcatactgaattagaggaatacagacctgagttttcaaatttttcaaaggttgaagattaccagttaccagatgccaaaacttccagcagcaccaaggccggcctccaggatgcctctgggaacttggttcctctggaggatgtccacatcaaagggagaatcatagacactgtagcccaggtcattgtttttcagacatacacaaataaaagtcacgtgcccattgaggcaaaatatatctttcctttggatgacaaggccgctgtgtgtggcttcgaagccttcatcaatgggaagcacatagttggagagattaaagagaaggaagaagcccagcaagagtacctagaagccgtgacccagggccatggcgcttacctgatgagtcaggatgctccggacgtttttactgtaagtgttggaaacttaccccctaaggctaaggttcttataaaaattacctacatcacagaactcagcatcctgggcactgttggtgtctttttcatgcccgccaccgtagcaccctggcaacaggacaaggctttgaatgaaaaccttcaggatacagtagagaagatttgtataaaagaaataggaacaaagcaaagcttctctttgactatgtctattgagatgccgtatgtgattgaattcattttcagtgatacacatgaactgaaacaaaagcgcacagactgcaaagctgtcattagcaccatggaaggcagctccttagacagcagtggattttctctccacatcggtttgtctgctgcctatctcccaagaatgtgggttgaaaaacatccagaaaaagaaagcgaggcttgcatgcttgtctttcaacccgatctcgatgtcgacctccctgacctagccagtgagagcgaagtgattatttgtcttgactgctccagttccatggagggtgtgacattcttgcaagccaagcaaatcaccttgcatgcgctgtccttggtgggtgagaagcagaaagtaaatattatccagttcggcacaggttacaaggagctattttcgtatcctaagcatatcacaagcaataccacggcagcagagttcatcatgtctgccacacctaccatggggaacacagacttctggaaaacactccgatatcttagcttattgtaccctgctcgagggtcacggaacatcctcctggtgtctgatgggcacctccaggatgagagcctgacattacagctcgtgaagaggagccgcccgcacaccaggttattcgcctgcggtatcggttctacagcaaatcgtcacgtcttaaggattttgtcccagtgtggtgccggagtatttgaatattttaatgcaaaatccaagcatagttggagaaaacagatagaagaccaaatgaccaggctatgttctccgagttgccactctgtctccgtcaaatggcagcaactcaatccagatgcgcccgaggccctgcaggccccagcccaggtgccatccttgtttcgcaatgatcgactccttgtctatggattcattcctcactgcacacaagcaactctgtgtgcactaattcaagagaaagaattttgtacaatggtgtcgactactgagcttcagaagacaactggaactatgatccacaagctggcagcccgagctctaatcagagattatgaagatggcattcttcacgaaaatgaaaccagtcatgagatgaaaaaacaaaccttgaaatctctgattattaaactcagtaaagaaaactctctcataacacaatttacaagctttgtggcagttgagaaaagggatgagaatgagtcgccttttcctgatattccaaaagtttctgaacttattgccaaagaagatgtagacttcctgccctacatgagctggcagggggagccccaagaagccgtcaggaaccagtctcttttagcatcctctgagtggccagaattacgtttatccaaacgaaaacataggaaaattccattttccaaaagaaaaatggaattatctcagccagaagtttctgaagattttgaagaggatggcttaggtgtactaccagctttcacatcaaatttggaacgtggaggtgtggaaaagctattggatttaagttggacagagtcatgtaaaccaacagcaactgaaccactatttaagaaagtcagtccatgggaaacatctacttctagcttttttcctattttggctccggccgttggttcctatcttaccccgactacccgcgctcacagtcctgcttccttgtcttttgcctcatatcgtcaggtagctagtttcggttcagctgctcctcccagacagtttgatgcatctcaattcagccaaggccctgtgcctggcacttgtgctgactggatcccacagtcggcgtcttgtcccacaggacctccccagaacccaccttctgcaccctattgtggcattgttttttcagggagctcattaagctctgcacagtctgctccactgcaacatcctggaggctttactaccaggccttctgctggcaccttccctgagctggattctccccagcttcatttctctcttcctacagaccctgatcccatcagaggttttgggtcttatcatccctctgcttactctccttttcattttcaaccttccgcagcctctttgactgccaaccttaggctgccaatggcctctgctttacctgaggctctttgcagtcagtcccggactaccccagtagatctctgtcttctagaagaatcagtaggcagtctcgaaggaagtcgatgtcctgtctttgcttttcaaagttctgacacagaaagtgatgagctatcagaagtacttcaagacagctgctttttacaaataaagtgtgatacaaaagatgacagtatcccgtgctttctggaattaaaagaagaggatgaaatagtgtgcacacaacactggcaggatgctgtgccttggacagaactcctcagtctacagacagaggatggcttctggaaacttacaccagaactgggacttatattaaatcttaatacaaatggtttgcacagctttcttaaacaaaaaggcattcaatctctaggtgtaaaaggaagagaatgtctcctggacctaattgccacaatgctggtactacagtttattcgcaccaggttggaaaaagagggaatagtgttcaaatcactgatgaaaatggatgacccttctatttccaggaatattccctgggcttttgaggcaataaagcaagcaagtgaatgggtaagaagaactgaaggacagtacccatctatctgcccacggcttgaactggggaacgactgggactctgccaccaagcagttgctgggactccagcccataagcactgtgtcccctcttcatagagtcctccattacagtcaaggctaa

SEQ ID NO: 54 - protein, 351 aa, Artificial Sequence
  Description of Artificial Sequence: Synthetic Saccaromyces cerevisiae and Homo sapiens polypeptide
MKLLSSIEQACDICRLKKLKCSKEKPKCAKCLKNNWECRYSPKTKRSPLTRAHLTEVESRLERLEQLFLLIFPREDLDMILKMDSLQDIKALLTGLGIPANLRLPMASALPEALCSQSRTTPVDLCLLEESVGSLEGSRCPVFAFQSSDTESDELSEVLQDSCFLQIKCDTKDDSIPCFLELKEEDEIVCTQHWQDAVPWTELLSLQTEDGFWKLTPELGLILNLNTNGLHSFLKQKGIQSLGVKGRECLLDLIATMLVLQFIRTRLEKEGIVFKSLMKMDDPSISRNIPWAFEAIKQASEWVRRTEGQYPSICPRLELGNDWDSATKQLLGLQPISTVSPLHRVLHYSQG

SEQ ID NO: 55 - DNA, 1056 bp, Artificial Sequence
  Description of Artificial Sequence: Synthetic Saccaromyces cerevisiae and Homo sapiens polynucleotide
atgaagctactgtcttctatcgaacaagcatgcgatatttgccgacttaaaaagctcaagtgctccaaagaaaaaccgaagtgcgccaagtgtctgaagaacaactgggagtgtcgctactctcccaaaaccaaaaggtctccgctgactagggcacatctgacagaagtggaatcaaggctagaaagactggaacagctatttctactgatttttcctcgagaagaccttgacatgattttgaaaatggattctttacaggatataaaagcattgttaacaggattaggaattcctgccaaccttaggctgccaatggcctctgctttacctgaggctctttgcagtcagtcccggactaccccagtagatctctgtcttctagaagaatcagtaggcagtctcgaaggaagtcgatgtcctgtctttgcttttcaaagttctgacacagaaagtgatgagctatcagaagtacttcaagacagctgctttttacaaataaagtgtgatacaaaagatgacagtatcccgtgctttctggaattaaaagaagaggatgaaatagtgtgcacacaacactggcaggatgctgtgccttggacagaactcctcagtctacagacagaggatggcttctggaaacttacaccagaactgggacttatattaaatcttaatacaaatggtttgcacagctttcttaaacaaaaaggcattcaatctctaggtgtaaaaggaagagaatgtctcctggacctaattgccacaatgctggtactacagtttattcgcaccaggttggaaaaagagggaatagtgttcaaatcactgatgaaaatggatgacccttctatttccaggaatattccctgggcttttgaggcaataaagcaagcaagtgaatgggtaagaagaactgaaggacagtacccatctatctgcccacggcttgaactggggaacgactgggactctgccaccaagcagttgctgggactccagcccataagcactgtgtcccctcttcatagagtcctccattacagtcaaggctaa

SEQ ID NO: 56 - protein, 1820 aa, Artificial Sequence
  Description of Artificial Sequence: Synthetic Saccaromyces cerevisiae and Homo sapiens polypeptide
MKLLSSIEQACDICRLKKLKCSKEKPKCAKCLKNNWECRYSPKTKRSPLTRAHLTEVESRLERLEQLFLLIFPREDLDMILKMDSLQDIKALLTGLMVMGIFANCIFCLKVKYLPQQQKKKLQTDIKENGGKFSFSLNPQCTHIILDNADVLSQYQLNSIQKNHVHIANPDFIWKSIREKRLLDVKNYDPYKPLDITPPPDQKASSSEVKTEGLCPDSATEEEDTVELTEFGMQNVEIPHLPQDFEVAKYNTLEKVGMEGGQEAVVVELQCSRDSRDCPFLISSHFLLDDGMETRRQFAIKKTSEDASEYFENYIEELKKQGFLLREHFTPEATQLASEQLQALLLEEVMNSSTLSQEVSDLVEMIWAEALGHLEHMLLKPVNRISLNDVSKAEGILLLVKAALKNGETAEQLQKMMTEFYRLIPHKGTMPKEVNLGLLAKKADLCQLIRDMVNVCETNLSKPNPPSLAKYRALRCKIEHVEQNTEEFLRVRKEVLQNHHSKSPVDVLQIFRVGRVNETTEFLSKLGNVRPLLHGSPVQNIVGILCRGLLLPKVVEDRGVQRTDVGNLGSGIYFSDSLSTSIKYSHPGETDGTRLLLICDVALGKCMDLHEKDFPLTEAPPGYDSVHGVSQTASVTTDFEDDEFVVYKTNQVKMKYIIKFSMPGDQIKDFHPSDHTELEEYRPEFSNFSKVEDYQLPDAKTSSSTKAGLQDASGNLVPLEDVHIKGRIIDTVAQVIVFQTYTNKSHVPIEAKYIFPLDDKAAVCGFEAFINGKHIVGEIKEKEEAQQEYLEAVTQGHGAYLMSQDAPDVFTVSVGNLPPKAKVLIKITYITELSILGTVGVFFMPATVAPWQQDKALNENLQDTVEKICIKEIGTKQSFSLTMSIEMPYVIEFIFSDTHELKQKRTDCKAVISTMEGSSLDSSGFSLHIGLSAAYLPRMWVEKHPEKESEACMLVFQPDLDVDLPDLASESEVIICLDCSSSMEGVTFLQAKQITLHALSLVGEKQKVNIIQFGTGYKELFSYPKHITSNTTAAEFIMSATPTMGNTDFWKTLRYLSLLYPARGSRNILLVSDGHLQDESLTLQLVKRSRPHTRLFACGIGSTANRHVLRILSQCGAGVFEYFNAKSKHSWRKQIEDQMTRLCSPSCHSVSVKWQQLNPDAPEALQAPAQVPSLFRNDRLLVYGFIPHCTQATLCALIQEKEFCTMVSTTELQKTTGTMIHKLAARALIRDYEDGILHENETSHEMKKQTLKSLIIKLSKENSLITQFTSFVAVEKRDENESPFPDIPKVSELIAKEDVDFLPYMSWQGEPQEAVRNQSLLASSEWPELRLSKRKHRKIPFSKRKMELSQPEVSEDFEEDGLGVLPAFTSNLERGGVEKLLDLSWTESCKPTATEPLFKKVSPWETSTSSFFPILAPAVGSYLTPTTRAHSPASLSFASYRQVASFGSAAPPRQFDASQFSQGPVPGTCADWIPQSASCPTGPPQNPPSAPYCGIVFSGSSLSSAQSAPLQHPGGFTTRPSAGTFPELDSPQLHFSLPTDPDPIRGFGSYHPSAYSPFHFQPSAASLTANLRLPMASALPEALCSQSRTTPVDLCLLEESVGSLEGSRCPVFAFQSSDTESDELSEVLQDSCFLQIKCDTKDDSIPCFLELKEEDEIVCTQHWQDAVPWTELLSLQTEDGFWKLTPELGLILNLNTNGLHSFLKQKGIQSLGVKGRECLLDLIATMLVLQFIRTRLEKEGIVFKSLMKMDDPSISRNIPWAFEAIKQASEWVRRTEGQYPSICPRLELGNDWDSATKQLLGLQPISTVSPLHRVLHYSQG

SEQ ID NO: 57 - DNA, 5463 bp, Artificial Sequence
  Description of Artificial Sequence: Synthetic Saccaromyces cerevisiae and Homo sapiens polynucleotide
atgaagctactgtcttctatcgaacaagcatgcgatatttgccgacttaaaaagctcaagtgctccaaagaaaaaccgaagtgcgccaagtgtctgaagaacaactgggagtgtcgctactctcccaaaaccaaaaggtctccgctgactagggcacatctgacagaagtggaatcaaggctagaaagactggaacagctatttctactgatttttcctcgagaagaccttgacatgattttgaaaatggattctttacaggatataaaagcattgttaacaggattaatggtgatgggaatctttgcaaattgtatcttctgtttgaaagtgaagtacttacctcagcagcagaagaaaaagctacaaactgacattaaggaaaatggcggaaagttttccttttcgttaaatcctcagtgcacacatataatcttagataatgctgatgttctgagtcagtaccaactgaattctatccaaaagaaccacgttcatattgcaaacccagattttatatggaaatctatcagagaaaagagactcttggatgtaaagaattatgatccttataagcccctggacatcacaccacctcctgatcagaaggcgagcagttctgaagtgaaaacagaaggtctatgcccggacagtgccacagaggaggaagacactgtggaactcactgagtttggtatgcagaatgttgaaattcctcatcttcctcaagattttgaagttgcaaaatataacaccttggagaaagtgggaatggagggaggccaggaagctgtggtggtggagcttcagtgttcgcgggactccagggactgtcctttcctgatatcctcacacttcctcctggatgatggcatggagactagaagacagtttgctataaagaaaacctctgaagatgcaagtgaatactttgaaaattacattgaagaactgaagaaacaaggatttctactaagagaacatttcacacctgaagcaacccaattagcatctgaacaattgcaagcattgcttttggaggaagtcatgaattcaagcactctgagccaagaggtgagcgatttagtagagatgatttgggcagaggccctgggccacctggaacacatgcttctcaagccagtgaacaggattagcctcaacgatgtgagcaaggcagaggggattctccttctagtaaaggcagcactgaaaaatggagaaacagcagagcaattgcaaaagatgatgacagagttttacagactgatacctcacaaaggcacaatgcccaaagaagtgaacctgggactattggctaagaaagcagacctctgccagctaataagagacatggttaatgtctgtgaaactaatttgtccaaacccaacccaccatccctggccaaataccgagctttgaggtgcaaaattgagcatgttgaacagaatactgaagaatttctcagggttagaaaagaggttttgcagaatcatcacagtaagagcccagtggatgtcttgcagatatttagagttggcagagtgaatgaaaccacagagtttttgagcaaacttggtaatgtgaggcccttgttgcatggttctcctgtacaaaacatcgtgggaatcttgtgtcgagggttgcttttacccaaagtagtggaagatcgtggtgtgcaaagaacagacgtcggaaaccttggaagtgggatttatttcagtgattcgctcagtacaagtatcaagtactcacacccgggagagacagatggcaccagactcctgctcatttgtgacgtagccctcggaaagtgtatggacttacatgagaaggactttcccttaactgaagcaccaccaggctacgacagtgtgcatggagtttcacaaacagcctctgtcaccacagactttgaggatgatgaatttgttgtctataaaaccaatcaggttaaaatgaaatatattattaaattttccatgcctggagatcagataaaggactttcatcctagtgatcatactgaattagaggaatacagacctgagttttcaaatttttcaaaggttgaagattaccagttaccagatgccaaaacttccagcagcaccaaggccggcctccaggatgcctctgggaacttggttcctctggaggatgtccacatcaaagggagaatcatagacactgtagcccaggtcattgtttttcagacatacacaaataaaagtcacgtgcccattgaggcaaaatatatctttcctttggatgacaaggccgctgtgtgtggcttcgaagccttcatcaatgggaagcacatagttggagagattaaagagaaggaagaagcccagcaagagtacctagaagccgtgacccagggccatggcgcttacctgatgagtcaggatgctccggacgtttttactgtaagtgttggaaacttaccccctaaggctaaggttcttataaaaattacctacatcacagaactcagcatcctgggcactgttggtgtctttttcatgcccgccaccgtagcaccctggcaacaggacaaggctttgaatgaaaaccttcaggatacagtagagaagatttgtataaaagaaataggaacaaagcaaagcttctctttgactatgtctattgagatgccgtatgtgattgaattcattttcagtgatacacatgaactgaaacaaaagcgcacagactgcaaagctgtcattagcaccatggaaggcagctccttagacagcagtggattttctctccacatcggtttgtctgctgcctatctcccaagaatgtgggttgaaaaacatccagaaaaagaaagcgaggcttgcatgcttgtctttcaacccgatctcgatgtcgacctccctgacctagccagtgagagcgaagtgattatttgtcttgactgctccagttccatggagggtgtgacattcttgcaagccaagcaaatcaccttgcatgcgctgtccttggtgggtgagaagcagaaagtaaatattatccagttcggcacaggttacaaggagctattttcgtatcctaagcatatcacaagcaataccacggcagcagagttcatcatgtctgccacacctaccatggggaacacagacttctggaaaacactccgatatcttagcttattgtaccctgctcgagggtcacggaacatcctcctggtgtctgatgggcacctccaggatgagagcctgacattacagctcgtgaagaggagccgcccgcacaccaggttattcgcctgcggtatcggttctacagcaaatcgtcacgtcttaaggattttgtcccagtgtggtgccggagtatttgaatattttaatgcaaaatccaagcatagttggagaaaacagatagaagaccaaatgaccaggctatgttctccgagttgccactctgtctccgtcaaatggcagcaactcaatccagatgcgcccgaggccctgcaggccccagcccaggtgccatccttgtttcgcaatgatcgactccttgtctatggattcattcctcactgcacacaagcaactctgtgtgcactaattcaagagaaagaattttgtacaatggtgtcgactactgagcttcagaagacaactggaactatgatccacaagctggcagcccgagctctaatcagagattatgaagatggcattcttcacgaaaatgaaaccagtcatgagatgaaaaaacaaaccttgaaatctctgattattaaactcagtaaagaaaactctctcataacacaatttacaagctttgtggcagttgagaaaagggatgagaatgagtcgccttttcctgatattccaaaagtttctgaacttattgccaaagaagatgtagacttcctgccctacatgagctggcagggggagccccaagaagccgtcaggaaccagtctcttttagcatcctctgagtggccagaattacgtttatccaaacgaaaacataggaaaattccattttccaaaagaaaaatggaattatctcagccagaagtttctgaagattttgaagaggatggcttaggtgtactaccagctttcacatcaaatttggaacgtggaggtgtggaaaagctattggatttaagttggacagagtcatgtaaaccaacagcaactgaaccactatttaagaaagtcagtccatgggaaacatctacttctagcttttttcctattttggctccggccgttggttcctatcttaccccgactacccgcgctcacagtcctgcttccttgtcttttgcctcatatcgtcaggtagctagtttcggttcagctgctcctcccagacagtttgatgcatctcaattcagccaaggccctgtgcctggcacttgtgctgactggatcccacagtcggcgtcttgtcccacaggacctccccagaacccaccttctgcaccctattgtggcattgttttttcagggagctcattaagctctgcacagtctgctccactgcaacatcctggaggctttactaccaggccttctgctggcaccttccctgagctggattctccccagcttcatttctctcttcctacagaccctgatcccatcagaggttttgggtcttatcatccctctgcttactctccttttcattttcaaccttccgcagcctctttgactgccaaccttaggctgccaatggcctctgctttacctgaggctctttgcagtcagtcccggactaccccagtagatctctgtcttctagaagaatcagtaggcagtctcgaaggaagtcgatgtcctgtctttgcttttcaaagttctgacacagaaagtgatgagctatcagaagtacttcaagacagctgctttttacaaataaagtgtgatacaaaagatgacagtatcccgtgctttctggaattaaaagaagaggatgaaatagtgtgcacacaacactggcaggatgctgtgccttggacagaactcctcagtctacagacagaggatggcttctggaaacttacaccagaactgggacttatattaaatcttaatacaaatggtttgcacagctttcttaaacaaaaaggcattcaatctctaggtgtaaaaggaagagaatgtctcctggacctaattgccacaatgctggtactacagtttattcgcaccaggttggaaaaagagggaatagtgttcaaatcactgatgaaaatggatgacccttctatttccaggaatattccctgggcttttgaggcaataaagcaagcaagtgaatgggtaagaagaactgaaggacagtacccatctatctgcccacggcttgaactggggaacgactgggactctgccaccaagcagttgctgggactccagcccataagcactgtgtcccctcttcatagagtcctccattacagtcaaggctaa

SEQ ID NO: 58 - protein, 491 aa, Artificial Sequence
  Description of Artificial Sequence: Synthetic and Homo sapiens polypeptide
MSKGEELFTGVVPILVELDGDVNGHKFSVSGEGEGDATYGKLTLKFICTTGKLPVPWPTLVTTFTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITHGMDELYKPANLRLPMASALPEALCSQSRTTPVDLCLLEESVGSLEGSRCPVFAFQSSDTESDELSEVLQDSCFLQIKCDTKDDSIPCFLELKEEDEIVCTQHWQDAVPWTELLSLQTEDGFWKLTPELGLILNLNTNGLHSFLKQKGIQSLGVKGRECLLDLIATMLVLQFIRTRLEKEGIVFKSLMKMDDPSISRNIPWAFEAIKQASEWVRRTEGQYPSICPRLELGNDWDSATKQLLGLQPISTVSPLHRVLHYSQG

SEQ ID NO: 59 - DNA, 1476 bp, Artificial Sequence
  Description of Artificial Sequence: Synthetic and Homo sapiens polynucleotide
atgagcaagggcgaggaactgttcactggcgtggtcccaattctcgtggaactggatggcgatgtgaatgggcacaaattttctgtcagcggagagggtgaaggtgatgccacatacggaaagctcaccctgaaattcatctgcaccactggaaagctccctgtgccatggccaacactggtcactaccttcacctatggcgtgcagtgcttttccagatacccagaccatatgaagcagcatgactttttcaagagcgccatgcccgagggctatgtgcaggagagaaccatctttttcaaagatgacgggaactacaagacccgcgctgaagtcaagttcgaaggtgacaccctggtgaatagaatcgagctgaagggcattgactttaaggaggatggaaacattctcggccacaagctggaatacaactataactcccacaatgtgtacatcatggccgacaagcaaaagaatggcatcaaggtcaacttcaagatcagacacaacattgaggatggatccgtgcagctggccgaccattatcaacagaacactccaatcggcgacggccctgtgctcctcccagacaaccattacctgtccacccagtctgccctgtctaaagatcccaacgaaaagagagaccacatggtcctgctggagtttgtgaccgctgctgggatcacacatggcatggacgagctgtacaagcctgccaaccttaggctgccaatggcctctgctttacctgaggctctttgcagtcagtcccggactaccccagtagatctctgtcttctagaagaatcagtaggcagtctcgaaggaagtcgatgtcctgtctttgcttttcaaagttctgacacagaaagtgatgagctatcagaagtacttcaagacagctgctttttacaaataaagtgtgatacaaaagatgacagtatcccgtgctttctggaattaaaagaagaggatgaaatagtgtgcacacaacactggcaggatgctgtgccttggacagaactcctcagtctacagacagaggatggcttctggaaacttacaccagaactgggacttatattaaatcttaatacaaatggtttgcacagctttcttaaacaaaaaggcattcaatctctaggtgtaaaaggaagagaatgtctcctggacctaattgccacaatgctggtactacagtttattcgcaccaggttggaaaaagagggaatagtgttcaaatcactgatgaaaatggatgacccttctatttccaggaatattccctgggcttttgaggcaataaagcaagcaagtgaatgggtaagaagaactgaaggacagtacccatctatctgcccacggcttgaactggggaacgactgggactctgccaccaagcagttgctgggactccagcccataagcactgtgtcccctcttcatagagtcctccattacagtcaaggctaa

SEQ ID NO: 60 - protein, 1961 aa, Artificial Sequence [sequence omitted]

SEQ ID NO: 61 - DNA, 5889 bp, Artificial Sequence
  Description of Artificial Sequence: Synthetic and Homo sapiens polynucleotide
atgagcaagggcgaggaactgttcactggcgtggtcccaattctcgtggaactggatggcgatgtgaatgggcacaaattttctgtcagcggagagggtgaaggtgatgccacatacggaaagctcaccctgaaattcatctgcaccactggaaagctccctgtgccatggccaacactggtcactaccttcacctatggcgtgcagtgcttttccagatacccagaccatatgaagcagcatgactttttcaagagcgccatgcccgagggctatgtgcaggagagaaccatctttttcaaagatgacgggaactacaagacccgcgctgaagtcaagttcgaaggtgacaccctggtgaatagaatcgagctgaagggcattgactttaaggaggatggaaacattctcggccacaagctggaatacaactataactcccacaatgtgtacatcatggccgacaagcaaaagaatggcatcaaggtcaacttcaagatcagacacaacattgaggatggatccgtgcagctggccgaccattatcaacagaacactccaatcggcgacggccctgtgctcctcccagacaaccattacctgtccacccagtctgccctgtctaaagatcccaacgaaaagagagaccacatggtcctgctggagtttgtgaccgctgctgggatcacacatggcatggacgagctgtacaagatggtgatgggaatctttgcaaattgtatcttctgtttgaaagtgaagtacttacctcagcagcagaagaaaaagctacaaactgacattaaggaaaatggcggaaagttttccttttcgttaaatcctcagtgcacacatataatcttagataatgctgatgttctgagtcagtaccaactgaattctatccaaaagaaccacgttcatattgcaaacccagattttatatggaaatctatcagagaaaagagactcttggatgtaaagaattatgatccttataagcccctggacatcacaccacctcctgatcagaaggcgagcagttctgaagtgaaaacagaaggtctatgcccggacagtgccacagaggaggaagacactgtggaactcactgagtttggtatgcagaatgttgaaattcctcatcttcctcaagattttgaagttgcaaaatataacaccttggagaaagtgggaatggagggaggccaggaagctgtggtggtggagcttcagtgttcgcgggactccagggactgtcctttcctgatatcctcacacttcctcctggatgatggcatggagactagaagacagtttgctataaagaaaacctctgaagatgcaagtgaatactttgaaaattacattgaagaactgaagaaacaaggatttctactaagagaacatttcacacctgaagcaacccaattagcatctgaacaattgcaagcattgcttttggaggaagtcatgaattcaagcactctgagccaagaggtgagcgatttagtagagatgatttgggcagaggccctgggccacctggaacacatgcttctcaagccagtgaacaggattagcctcaacgatgtgagcaaggcagaggggattctccttctagtaaaggcagcactgaaaaatggagaaacagcagagcaattgcaaaagatgatgacagagttttacagactgatacctcacaaaggcacaatgcccaaagaagtgaacctgggactattggctaagaaagcagacctctgccagctaataagagacatggttaatgtctgtgaaactaatttgtccaaacccaacccaccatccctggccaaataccgagctttgaggtgcaaaattgagcatgttgaacagaatactgaagaatttctcagggttagaaaagaggttttgcagaatcatcacagtaagagcccagtggatgtcttgcagatatttagagttggcagagtgaatgaaaccacagagtttttgagcaaacttggtaatgtgaggcccttgttgcatggttctcctgtacaaaacatcgtgggaatcttgtgtcgagggttgcttttacccaaagtagtggaagatcgtggtgtgcaaagaacagacgtcggaaaccttggaagtgggatttatttcagtgattcgctcagtacaagtatcaagtactcacacccgggagagacagatggcaccagactcctgctcatttgtgacgtagccctcggaaagtgtatggacttacatgagaaggactttcccttaactgaagcaccaccaggctacgacagtgtgcatggagtttcacaaacagcctctgtcaccacagactttgaggatgatgaatttgttgtctataaaaccaatcaggttaaaatgaaatatattattaaattttccatgcctggagatcagataaaggactttcatcctagtgatcatactgaattagaggaatacagacctgagttttcaaatttttcaaaggttgaagattaccagttaccagatgccaaaacttccagcagcaccaaggccggcctccaggatgcctctgggaacttggttcctctggaggatgtccacatcaaagggagaatcatagacactgtagcccaggtcattgtttttcagacatacacaaataaaagtcacgtgcccattgaggcaaaatatatctttcctttggatgacaaggccgctgtgtgtggcttcgaagccttcatcaatgggaagcacatagttggagagattaaagagaaggaagaagcccagcaagagtacctagaagccgtgacccagggccatggcgcttacctgatgagtcaggatgctccggacgtttttactgtaagtgttggaaacttaccccctaaggctaaggttcttataaaaattacctacatcacagaactcagcatcctgggcactgttggtgtctttttcatgcccgccaccgtagcaccctggcaacaggacaaggctttgaatgaaaaccttcaggatacagtagagaagatttgtataaaagaaataggaacaaagcaaagcttctctttgactatgtctattgagatgccgtatgtgattgaattcattttcagtgatacacatgaactgaaacaaaagcgcacagactgcaaagctgtcattagcaccatggaaggcagctccttagacagcagtggattttctctccacatcggtttgtctgctgcctatctcccaagaatgtgggttgaaaaacatccagaaaaagaaagcgaggcttgcatgcttgtctttcaacccgatctcgatgtcgacctccctgacctagccagtgagagcgaagtgattatttgtcttgactgctccagttccatggagggtgtgacattcttgcaagccaagcaaatcaccttgcatgcgctgtccttggtgggtgagaagcagaaagtaaatattatccagttcggcacaggttacaaggagctattttcgtatcctaagcatatcacaagcaataccacggcagcagagttcatcatgtctgccacacctaccatggggaacacagacttctggaaaacactccgatatcttagcttattgtaccctgctcgagggtcacggaacatcctcctggtgtctgatgggcacctccaggatgagagcctgacattacagctcgtgaagaggagccgcccgcacaccaggttattcgcctgcggtatcggttctacagcaaatcgtcacgtcttaaggattttgtcccagtgtggtgccggagtatttgaatattttaatgcaaaatccaagcatagttggagaaaacagatagaagaccaaatgaccaggctatgttctccgagttgccactctgtctccgtcaaatggcagcaactcaatccagatgcgcccgaggccctgcaggccccagcccaggtgccatccttgtttcgcaatgatcgactccttgtctatggattcattcctcactgcacacaagcaactctgtgtgcactaattcaagagaaagaattttgtacaatggtgtcgactactgagcttcagaagacaactggaactatgatccacaagctggcagcccgagctctaatcagagattatgaagatggcattcttcacgaaaatgaaaccagtcatgagatgaaaaaacaaaccttgaaatctctgattattaaactcagtaaagaaaactctctcataacacaatttacaagctttgtggcagttgagaaaagggatgagaatgagtcgccttttcctgatattccaaaagtttctgaacttattgccaaagaagatgtagacttcctgccctacatgagctggcagggggagccccaagaagccgtcaggaaccagtctcttttagcatcctctgagtggccagaattacgtttatccaaacgaaaacataggaaaattccattttccaaaagaaaaatggaattatctcagccagaagtttctgaagattttgaagaggatggcttaggtgtactaccagctttcacatcaaatttggaacgtggaggtgtggaaaagctattggatttaagttggacagagtcatgtaaaccaacagcaactgaaccactatttaagaaagtcagtccatgggaaacatctacttctagcttttttcctattttggctccggccgttggttcctatcttaccccgactacccgcgctcacagtcctgcttccttgtcttttgcctcatatcgtcaggtagctagtttcggttcagctgctcctcccagacagtttgatgcatctcaattcagccaaggccctgtgcctggcacttgtgctgactggatcccacagtcggcgtcttgtcccacaggacctccccagaacccaccttctgcaccctattgtggcattgttttttcagggagctcattaagctctgcacagtctgctccactgcaacatcctggaggctttactaccaggccttctgctggcaccttccctgagctggattctccccagcttcatttctctcttcctacagaccctgatcccatcagaggttttgggtcttatcatccctctgcttactctccttttcattttcaaccttccgcagcctctttgactgccaaccttaggctgccaatggcctctgctttacctgaggctctttgcagtcagtcccggactaccccagtagatctctgtcttctagaagaatcagtaggcagtctcgaaggaagtcgatgtcctgtctttgcttttcaaagttctgacacagaaagtgatgagctatcagaagtacttcaagacagctgctttttacaaataaagtgtgatacaaaagatgacagtatcccgtgctttctggaattaaaagaagaggatgaaatagtgtgcacacaacactggcaggatgctgtgccttggacagaactcctcagtctacagacagaggatggcttctggaaacttacaccagaactgggacttatattaaatcttaatacaaatggtttgcacagctttcttaaacaaaaaggcattcaatctctaggtgtaaaaggaagagaatgtctcctggacctaattgccacaatgctggtactacagtttattcgcaccaggttggaaaaagagggaatagtgttcaaatcactgatgaaaatggatgacccttctatttccaggaatattccctgggcttttgaggcaataaagcaagcaagtgaatgggtaagaagaactgaaggacagtacccatctatctgcccacggcttgaactggggaacgactgggactctgccaccaagcagttgctgggactccagcccataagcactgtgtcccctcttcatagagtcctccattacagtcaaggctaa

SEQ ID NO: 62 - protein, 385 aa, Artificial Sequence
  Description of Artificial Sequence: Synthetic Levivirus and Homo sapiens polypeptide
MASNFTQFVLVDNGGTGDVTVAPSNFANGVAEWISSNSRSQAYKVTCSVRQSSAQNRKYTIKVEVPKVATQTVGGVELPVAAWRSYLNMELTIPIFATNSDCELIVKAMQGLLKDGNPIPSAIAANSGIYGIPANLRLPMASALPEALCSQSRTTPVDLCLLEESVGSLEGSRCPVFAFQSSDTESDELSEVLQDSCFLQIKCDTKDDSIPCFLELKEEDEIVCTQHWQDAVPWTELLSLQTEDGFWKLTPELGLILNLNTNGLHSFLKQKGIQSLGVKGRECLLDLIATMLVLQFIRTRLEKEGIVFKSLMKMDDPSISRNIPWAFEAIKQASEWVRRTEGQYPSICPRLELGNDWDSATKQLLGLQPISTVSPLHRVLHYSQG

SEQ ID NO: 63 - DNA, 1158 bp, Artificial Sequence
  Description of Artificial Sequence: Synthetic Levivirus and Homo sapiens polynucleotide
atggcttctaactttactcagttcgttctcgtcgacaatggcggaactggcgacgtgactgtcgccccaagcaacttcgctaacggggtcgctgaatggatcagctctaactcgcgttcacaggcttacaaagtaacctgtagcgttcgtcagagctctgcgcagaatcgcaaatacaccatcaaagtcgaggtgcctaaagtggcaacccagactgttggtggtgtagagcttcctgtagccgcatggcgttcgtacttaaatatggaactaaccattccaattttcgctacgaattccgactgcgagcttattgttaaggcaatgcaaggtctcctaaaagatggaaacccgattccctcagcaatcgcagcaaactccggcatctacggaattcctgccaaccttaggctgccaatggcctctgctttacctgaggctctttgcagtcagtcccggactaccccagtagatctctgtcttctagaagaatcagtaggcagtctcgaaggaagtcgatgtcctgtctttgcttttcaaagttctgacacagaaagtgatgagctatcagaagtacttcaagacagctgctttttacaaataaagtgtgatacaaaagatgacagtatcccgtgctttctggaattaaaagaagaggatgaaatagtgtgcacacaacactggcaggatgctgtgccttggacagaactcctcagtctacagacagaggatggcttctggaaacttacaccagaactgggacttatattaaatcttaatacaaatggtttgcacagctttcttaaacaaaaaggcattcaatctctaggtgtaaaaggaagagaatgtctcctggacctaattgccacaatgctggtactacagtttattcgcaccaggttggaaaaagagggaatagtgttcaaatcactgatgaaaatggatgacccttctatttccaggaatattccctgggcttttgaggcaataaagcaagcaagtgaatgggtaagaagaactgaaggacagtacccatctatctgcccacggcttgaactggggaacgactgggactctgccaccaagcagttgctgggactccagcccataagcactgtgtcccctcttcatagagtcctccattacagtcaaggctaa

SEQ ID NO: 64 - protein, 1854 aa, Artificial Sequence [sequence omitted]

SEQ ID NO: 65 - DNA, 5565 bp, Artificial Sequence
  Description of Artificial Sequence: Synthetic Levivirus and Homo sapiens polynucleotide
atggcttctaactttactcagttcgttctcgtcgacaatggcggaactggcgacgtgactgtcgccccaagcaacttcgctaacggggtcgctgaatggatcagctctaactcgcgttcacaggcttacaaagtaacctgtagcgttcgtcagagctctgcgcagaatcgcaaatacaccatcaaagtcgaggtgcctaaagtggcaacccagactgttggtggtgtagagcttcctgtagccgcatggcgttcgtacttaaatatggaactaaccattccaattttcgctacgaattccgactgcgagcttattgttaaggcaatgcaaggtctcctaaaagatggaaacccgattccctcagcaatcgcagcaaactccggcatctacatggtgatgggaatctttgcaaattgtatcttctgtttgaaagtgaagtacttacctcagcagcagaagaaaaagctacaaactgacattaaggaaaatggcggaaagttttccttttcgttaaatcctcagtgcacacatataatcttagataatgctgatgttctgagtcagtaccaactgaattctatccaaaagaaccacgttcatattgcaaacccagattttatatggaaatctatcagagaaaagagactcttggatgtaaagaattatgatccttataagcccctggacatcacaccacctcctgatcagaaggcgagcagttctgaagtgaaaacagaaggtctatgcccggacagtgccacagaggaggaagacactgtggaactcactgagtttggtatgcagaatgttgaaattcctcatcttcctcaagattttgaagttgcaaaatataacaccttggagaaagtgggaatggagggaggccaggaagctgtggtggtggagcttcagtgttcgcgggactccagggactgtcctttcctgatatcctcacacttcctcctggatgatggcatggagactagaagacagtttgctataaagaaaacctctgaagatgcaagtgaatactttgaaaattacattgaagaactgaagaaacaaggatttctactaagagaacatttcacacctgaagcaacccaattagcatctgaacaattgcaagcattgcttttggaggaagtcatgaattcaagcactctgagccaagaggtgagcgatttagtagagatgatttgggcagaggccctgggccacctggaacacatgcttctcaagccagtgaacaggattagcctcaacgatgtgagcaaggcagaggggattctccttctagtaaaggcagcactgaaaaatggagaaacagcagagcaattgcaaaagatgatgacagagttttacagactgatacctcacaaaggcacaatgcccaaagaagtgaacctgggactattggctaagaaagcagacctctgccagctaataagagacatggttaatgtctgtgaaactaatttgtccaaacccaacccaccatccctggccaaataccgagctttgaggtgcaaaattgagcatgttgaacagaatactgaagaatttctcagggttagaaaagaggttttgcagaatcatcacagtaagagcccagtggatgtcttgcagatatttagagttggcagagtgaatgaaaccacagagtttttgagcaaacttggtaatgtgaggcccttgttgcatggttctcctgtacaaaacatcgtgggaatcttgtgtcgagggttgcttttacccaaagtagtggaagatcgtggtgtgcaaagaacagacgtcggaaaccttggaagtgggatttatttcagtgattcgctcagtacaagtatcaagtactcacacccgggagagacagatggcaccagactcctgctcatttgtgacgtagccctcggaaagtgtatggacttacatgagaaggactttcccttaactgaagcaccaccaggctacgacagtgtgcatggagtttcacaaacagcctctgtcaccacagactttgaggatgatgaatttgttgtctataaaaccaatcaggttaaaatgaaatatattattaaattttccatgcctggagatcagataaaggactttcatcctagtgatcatactgaattagaggaatacagacctgagttttcaaatttttcaaaggttgaagattaccagttaccagatgccaaaacttccagcagcaccaaggccggcctccaggatgcctctgggaacttggttcctctggaggatgtccacatcaaagggagaatcatagacactgtagcccaggtcattgtttttcagacatacacaaataaaagtcacgtgcccattgaggcaaaatatatctttcctttggatgacaaggccgctgtgtgtggcttcgaagccttcatcaatgggaagcacatagttggagagattaaagagaaggaagaagcccagcaagagtacctagaagccgtgacccagggccatggcgcttacctgatgagtcaggatgctccggacgtttttactgtaagtgttggaaacttaccccctaaggctaaggttcttataaaaattacctacatcacagaactcagcatcctgggcactgttggtgtctttttcatgcccgccaccgtagcaccctggcaacaggacaaggctttgaatgaaaaccttcaggatacagtagagaagatttgtataaaagaaataggaacaaagcaaagcttctctttgactatgtctattgagatgccgtatgtgattgaattcattttcagtgatacacatgaactgaaacaaaagcgcacagactgcaaagctgtcattagcaccatggaaggcagctccttagacagcagtggattttctctccacatcggtttgtctgctgcctatctcccaagaatgtgggttgaaaaacatccagaaaaagaaagcgaggcttgcatgcttgtctttcaacccgatctcgatgtcgacctccctgacctagccagtgagagcgaagtgattatttgtcttgactgctccagttccatggagggtgtgacattcttgcaagccaagcaaatcaccttgcatgcgctgtccttggtgggtgagaagcagaaagtaaatattatccagttcggcacaggttacaaggagctattttcgtatcctaagcatatcacaagcaataccacggcagcagagttcatcatgtctgccacacctaccatggggaacacagacttctggaaaacactccgatatcttagcttattgtaccctgctcgagggtcacggaacatcctcctggtgtctgatgggcacctccaggatgagagcctgacattacagctcgtgaagaggagccgcccgcacaccaggttattcgcctgcggtatcggttctacagcaaatcgtcacgtcttaaggattttgtcccagtgtggtgccggagtatttgaatattttaatgcaaaatccaagcatagttggagaaaacagatagaagaccaaatgaccaggctatgttctccgagttgccactctgtctccgtcaaatggcagcaactcaatccagatgcgcccgaggccctgcaggccccagcccaggtgccatccttgtttcgcaatgatcgactccttgtctatggattcattcctcactgcacacaagcaactctgtgtgcactaattcaagagaaagaattttgtacaatggtgtcgactactgagcttcagaagacaactggaactatgatccacaagctggcagcccgagctctaatcagagattatgaagatggcattcttcacgaaaatgaaaccagtcatgagatgaaaaaacaaaccttgaaatctctgattattaaactcagtaaagaaaactctctcataacacaatttacaagctttgtggcagttgagaaaagggatgagaatgagtcgccttttcctgatattccaaaagtttctgaacttattgccaaagaagatgtagacttcctgccctacatgagctggcagggggagccccaagaagccgtcaggaaccagtctcttttagcatcctctgagtggccagaattacgtttatccaaacgaaaacataggaaaattccattttccaaaagaaaaatggaattatctcagccagaagtttctgaagattttgaagaggatggcttaggtgtactaccagctttcacatcaaatttggaacgtggaggtgtggaaaagctattggatttaagttggacagagtcatgtaaaccaacagcaactgaaccactatttaagaaagtcagtccatgggaaacatctacttctagcttttttcctattttggctccggccgttggttcctatcttaccccgactacccgcgctcacagtcctgcttccttgtcttttgcctcatatcgtcaggtagctagtttcggttcagctgctcctcccagacagtttgatgcatctcaattcagccaaggccctgtgcctggcacttgtgctgactggatcccacagtcggcgtcttgtcccacaggacctccccagaacccaccttctgcaccctattgtggcattgttttttcagggagctcattaagctctgcacagtctgctccactgcaacatcctggaggctttactaccaggccttctgctggcaccttccctgagctggattctccccagcttcatttctctcttcctacagaccctgatcccatcagaggttttgggtcttatcatccctctgcttactctccttttcattttcaaccttccgcagcctctttgactgccaaccttaggctgccaatggcctctgctttacctgaggctctttgcagtcagtcccggactaccccagtagatctctgtcttctagaagaatcagtaggcagtctcgaaggaagtcgatgtcctgtctttgcttttcaaagttctgacacagaaagtgatgagctatcagaagtacttcaagacagctgctttttacaaataaagtgtgatacaaaagatgacagtatcccgtgctttctggaattaaaagaagaggatgaaatagtgtgcacacaacactggcaggatgctgtgccttggacagaactcctcagtctacagacagaggatggcttctggaaacttacaccagaactgggacttatattaaatcttaatacaaatggtttgcacagctttcttaaacaaaaaggcattcaatctctaggtgtaaaaggaagagaatgtctcctggacctaattgccacaatgctggtactacagtttattcgcaccaggttggaaaaagagggaatagtgttcaaatcactgatgaaaatggatgacccttctatttccaggaatattccctgggcttttgaggcaataaagcaagcaagtgaatgggtaagaagaactgaaggacagtacccatctatctgcccacggcttgaactggggaacgactgggactctgccaccaagcagttgctgggactccagcccataagcactgtgtcccctcttcatagagtcctccattacagtcaaggctaa

SEQ ID NO: 66 - protein, 550 aa, Photinus pyralis
MEDAKNIKKGPAPFYPLEDGTAGEQLHKAMKRYALVPGTIAFTDAHIEVDITYAEYFEMSVRLAEAMKRYGLNTNHRIVVCSENSLQFFMPVLGALFIGVAVAPANDIYNERELLNSMGISQPTVVFVSKKGLQKILNVQKKLPIIQKIIIMDSKTDYQGFQSMYTFVTSHLPPGFNEYDFVPESFDRDKTIALIMNSSGSTGLPKGVALPHRTACVRFSHARDPIFGNQIIPDTAILSVVPFHHGFGMFTTLGYLICGFRVVLMYRFEEELFLRSLQDYKIQSALLVPTLFSFFAKSTLIDKYDLSNLHEIASGGAPLSKEVGEAVAKRFHLPGIRQGYGLTETTSAILITPEGDDKPGAVGKVVPFFEAKVVDLDTGKTLGVNQRGELCVRGPMIMSGYVNNPEATNALIDKDGWLHSGDIAYWDEDEHFFIVDRLKSLIKYKGYQVAPAELESILLQHPNIFDAGVAGLPDDDAGELPAAVVVLEHGKTMTEKEIVDYVASQVTTAKKLRGGVVFVDEVPKGLTGKLDARKIREILIKAKKGGKIAV

SEQ ID NO: 67 - DNA, 1654 bp, Photinus pyralis
atggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgcaggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtggtaa

SEQ ID NO: 68 - protein, 805 aa, Artificial Sequence [sequence omitted]

SEQ ID NO: 69 - DNA, 2418 bp, Artificial Sequence
  Description of Artificial Sequence: Synthetic Photinus pyralis and Homo sapiens polynucleotide
atggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgcaggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgggaattcctgccaaccttaggctgccaatggcctctgctttacctgaggctctttgcagtcagtcccggactaccccagtagatctctgtcttctagaagaatcagtaggcagtctcgaaggaagtcgatgtcctgtctttgcttttcaaagttctgacacagaaagtgatgagctatcagaagtacttcaagacagctgctttttacaaataaagtgtgatacaaaagatgacagtatcccgtgctttctggaattaaaagaagaggatgaaatagtgtgcacacaacactggcaggatgctgtgccttggacagaactcctcagtctacagacagaggatggcttctggaaacttacaccagaactgggacttatattaaatcttaatacaaatggtttgcacagctttcttaaacaaaaaggcattcaatctctaggtgtaaaaggaagagaatgtctcctggacctaattgccacaatgctggtactacagtttattcgcaccaggttggaaaaagagggaatagtgttcaaatcactgatgaaaatggatgacccttctatttccaggaatattccctgggcttttgaggcaataaagcaagcaagtgaatgggtaagaagaactgaaggacagtacccatctatctgcccacggcttgaactggggaacgactgggactctgccaccaagcagttgctgggactccagcccataagcactgtgtcccctcttcatagagtcctccattacagtcaaggctaa

SEQ ID NO: 70 - protein, 2274 aa, Artificial Sequence [sequence omitted]

SEQ ID NO: 71 - DNA, 6825 bp, Artificial Sequence
  Description of Artificial Sequence: Synthetic Photinus pyralis and Homo sapiens polynucleotide
atggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgcaggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgatggtgatgggaatctttgcaaattgtatcttctgtttgaaagtgaagtacttacctcagcagcagaagaaaaagctacaaactgacattaaggaaaatggcggaaagttttccttttcgttaaatcctcagtgcacacatataatcttagataatgctgatgttctgagtcagtaccaactgaattctatccaaaagaaccacgttcatattgcaaacccagattttatatggaaatctatcagagaaaagagactcttggatgtaaagaattatgatccttataagcccctggacatcacaccacctcctgatcagaaggcgagcagttctgaagtgaaaacagaaggtctatgcccggacagtgccacagaggaggaagacactgtggaactcactgagtttggtatgcagaatgttgaaattcctcatcttcctcaagattttgaagttgcaaaatataacaccttggagaaagtgggaatggagggaggccaggaagctgtggtggtggagcttcagtgttcgcgggactccagggactgtcctttcctgatatcctcacacttcctcctggatgatggcatggagactagaagacagtttgctataaagaaaacctctgaagatgcaagtgaatactttgaaaattacattgaagaactgaagaaacaaggatttctactaagagaacatttcacacctgaagcaacccaattagcatctgaacaattgcaagcattgcttttggaggaagtcatgaattcaagcactctgagccaagaggtgagcgatttagtagagatgatttgggcagaggccctgggccacctggaacacatgcttctcaagccagtgaacaggattagcctcaacgatgtgagcaaggcagaggggattctccttctagtaaaggcagcactgaaaaatggagaaacagcagagcaattgcaaaagatgatgacagagttttacagactgatacctcacaaaggcacaatgcccaaagaagtgaacctgggactattggctaagaaagcagacctctgccagctaataagagacatggttaatgtctgtgaaactaatttgtccaaacccaacccaccatccctggccaaataccgagctttgaggtgcaaaattgagcatgttgaacagaatactgaagaatttctcagggttagaaaagaggttttgcagaatcatcacagtaagagcccagtggatgtcttgcagatatttagagttggcagagtgaatgaaaccacagagtttttgagcaaacttggtaatgtgaggcccttgttgcatggttctcctgtacaaaacatcgtgggaatcttgtgtcgagggttgcttttacccaaagtagtggaagatcgtggtgtgcaaagaacagacgtcggaaaccttggaagtgggatttatttcagtgattcgctcagtacaagtatcaagtactcacacccgggagagacagatggcaccagactcctgctcatttgtgacgtagccctcggaaagtgtatggacttacatgagaaggactttcccttaactgaagcaccaccaggctacgacagtgtgcatggagtttcacaaacagcctctgtcaccacagactttgaggatgatgaatttgttgtctataaaaccaatcaggttaaaatgaaatatattattaaattttccatgcctggagatcagataaaggactttcatcctagtgatcatactgaattagaggaatacagacctgagttttcaaatttttcaaaggttgaagattaccagttaccagatgccaaaacttccagcagcaccaaggccggcctccaggatgcctctgggaacttggttcctctggaggatgtccacatcaaagggagaatcatagacactgtagcccaggtcattgtttttcagacatacacaaataaaagtcacgtgcccattgaggcaaaatatatctttcctttggatgacaaggccgctgtgtgtggcttcgaagccttcatcaatgggaagcacatagttggagagattaaagagaaggaagaagcccagcaagagtacctagaagccgtgacccagggccatggcgcttacctgatgagtcaggatgctccggacgtttttactgtaagtgttggaaacttaccccctaaggctaaggttcttataaaaattacctacatcacagaactcagcatcctgggcactgttggtgtctttttcatgcccgccaccgtagcaccctggcaacaggacaaggctttgaatgaaaaccttcaggatacagtagagaagatttgtataaaagaaataggaacaaagcaaagcttctctttgactatgtctattgagatgccgtatgtgattgaattcattttcagtgatacacatgaactgaaacaaaagcgcacagactgcaaagctgtcattagcaccatggaaggcagctccttagacagcagtggattttctctccacatcggtttgtctgctgcctatctcccaagaatgtgggttgaaaaacatccagaaaaagaaagcgaggcttgcatgcttgtctttcaacccgatctcgatgtcgacctccctgacctagccagtgagagcgaagtgattatttgtcttgactgctccagttccatggagggtgtgacattcttgcaagccaagcaaatcaccttgcatgcgctgtccttggtgggtgagaagcagaaagtaaatattatccagttcggcacaggttacaaggagctattttcgtatcctaagcatatcacaagcaataccacggcagcagagttcatcatgtctgccacacctaccatggggaacacagacttctggaaaacactccgatatcttagcttattgtaccctgctcgagggtcacggaacatcctcctggtgtctgatgggcacctccaggatgagagcctgacattacagctcgtgaagaggagccgcccgcacaccaggttattcgcctgcggtatcggttctacagcaaatcgtcacgtcttaaggattttgtcccagtgtggtgccggagtatttgaatattttaatgcaaaatccaagcatagttggagaaaacagatagaagaccaaatgaccaggctatgttctccgagttgccactctgtctccgtcaaatggcagcaactcaatccagatgcgcccgaggccctgcaggccccagcccaggtgccatccttgtttcgcaatgatcgactccttgtctatggattcattcctcactgcacacaagcaactctgtgtgcactaattcaagagaaagaattttgtacaatggtgtcgactactgagcttcagaagacaactggaactatgatccacaagctggcagcccgagctctaatcagagattatgaagatggcattcttcacgaaaatgaaaccagtcatgagatgaaaaaacaaaccttgaaatctctgattattaaactcagtaaagaaaactctctcataacacaatttacaagctttgtggcagttgagaaaagggatgagaatgagtcgccttttcctgatattccaaaagtttctgaacttattgccaaagaagatgtagacttcctgccctacatgagctggcagggggagccccaagaagccgtcaggaaccagtctcttttagcatcctctgagtggccagaattacgtttatccaaacgaaaacataggaaaattccattttccaaaagaaaaatggaattatctcagccagaagtttctgaagattttgaagaggatggcttaggtgtactaccagctttcacatcaaatttggaacgtggaggtgtggaaaagctattggatttaagttggacagagtcatgtaaaccaacagcaactgaaccactatttaagaaagtcagtccatgggaaacatctacttctagcttttttcctattttggctccggccgttggttcctatcttaccccgactacccgcgctcacagtcctgcttccttgtcttttgcctcatatcgtcaggtagctagtttcggttcagctgctcctcccagacagtttgatgcatctcaattcagccaaggccctgtgcctggcacttgtgctgactggatcccacagtcggcgtcttgtcccacaggacctccccagaacccaccttctgcaccctattgtggcattgttttttcagggagctcattaagctctgcacagtctgctccactgcaacatcctggaggctttactaccaggccttctgctggcaccttccctgagctggattctccccagcttcatttctctcttcctacagaccctgatcccatcagaggttttgggtcttatcatccctctgcttactctccttttcattttcaaccttccgcagcctctttgactgccaaccttaggctgccaatggcctctgctttacctgaggctctttgcagtcagtcccggactaccccagtagatctctgtcttctagaagaatcagtaggcagtctcgaaggaagtcgatgtcctgtctttgcttttcaaagttctgacacagaaagtgatgagctatcagaagtacttcaagacagctgctttttacaaataaagtgtgatacaaaagatgacagtatcccgtgctttctggaattaaaagaagaggatgaaatagtgtgcacacaacactggcaggatgctgtgccttggacagaactcctcagtctacagacagaggatggcttctggaaacttacaccagaactgggacttatattaaatcttaatacaaatggtttgcacagctttcttaaacaaaaaggcattcaatctctaggtgtaaaaggaagagaatgtctcctggacctaattgccacaatgctggtactacagtttattcgcaccaggttggaaaaagagggaatagtgttcaaatcactgatgaaaatggatgacccttctatttccaggaatattccctgggcttttgaggcaataaagcaagcaagtgaatgggtaagaagaactgaaggacagtacccatctatctgcccacggcttgaactggggaacgactgggactctgccaccaagcagttgctgggactccagcccataagcactgtgtcccctcttcatagagtcctccattacagtcaaggctaa

SEQ ID NO: 72 - protein, 16 aa, Drosophila melanogaster
RQIKIWFQNARMKWKK

SEQ ID NO: 73 - DNA, 51 bp, Drosophila melanogaster
cgacagatcaagatctggtttcagaacgcacggatgaagtggaagaagtga

SEQ ID NO: 74 - protein, 909 aa, Artificial Sequence
  Description of Artificial Sequence: Synthetic Homo sapiens and Drosophila melanogaster polypeptide
MATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLRRQIKIWFQNARMKWKK

SEQ ID NO: 75 - DNA, 2730 bp, Artificial Sequence
  Description of Artificial Sequence: Synthetic Homo sapiens and Drosophila melanogaster polynucleotide
atggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgccgacagatcaagatctggtttcagaacgcacggatgaagtggaagaagtga

SEQ ID NO: 76 - protein, 877 aa, Artificial Sequence
  Description of Artificial Sequence: Synthetic Rattus norvegicus and Drosophila melanogaster polypeptide
MATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQKRQIKIWFQNARMKWKK

SEQ ID NO: 77 - DNA, 2634 bp, Artificial Sequence
  Description of Artificial Sequence: Synthetic Rattus norvegicus and Drosophila melanogaster polynucleotide
atggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatcaacctcttcagcacagccttcgggttgctggggctggggtctgatggtcagccgccagcacagaagcgacagatcaagatctggtttcagaacgcacggatgaagtggaagaagtga

SEQ ID NO: 78 - protein, 11 aa, Human immunodeficiency virus type 1
YGRKKRRQRRR

SEQ ID NO: 79 - DNA, 33 bp, Human immunodeficiency virus type 1
tacgggcggaagaagcggcgacagaggcgacgg

SEQ ID NO: 80 - protein, 904 aa, Artificial Sequence
  Description of Artificial Sequence: Synthetic Homo sapiens and Human immunodeficiency virus type 1 polypeptide
MATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLRYGRKKRRQRRR

SEQ ID NO: 81 - DNA, 2715 bp, Artificial Sequence
  Description of Artificial Sequence: Synthetic Homo sapiens and Human immunodeficiency virus type 1 polynucleotide
atggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctacgggcggaagaagcggcgacagaggcgacggtga

SEQ ID NO: 82 - protein, 872 aa, Artificial Sequence
  Description of Artificial Sequence: Synthetic Rattus norvegicus and Human immunodeficiency virus type 1 polypeptide
MATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQKYGRKKRRQRRR

SEQ ID NO: 83 - DNA, 2619 bp, Artificial Sequence
  Description of Artificial Sequence: Synthetic Rattus norvegicus and Human immunodeficiency virus type 1 polynucleotide
atggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatcaacctcttcagcacagccttcgggttgctggggctggggtctgatggtcagccgccagcacagaagtacgggcggaagaagcggcgacagaggcgacggtga

SEQ ID NO: 84 - protein, 179 aa, Artificial Sequence
  Description of Artificial Sequence: Synthetic polypeptide
DIVLTQSPASLAVSLGQRATMSCRAGESVDIFGVGFLHWYQQKPGQPPKLLIYRASNLESGIPVRFSGTGSRTDFTLIIDPVEADDVATYYCQQTNEDPYTFGGGTKLEIKGSTSGGGSGGGSGGGGSSEVQLQQSGAELVEPGASVKLSCTASGFNIKDTYMHWVKQRPEQGLEWIGR

SEQ ID NO: 85 - DNA, 747 bp, Artificial Sequence
  Description of Artificial Sequence: Synthetic polynucleotide
gacattgtgctgacccaatctccagcttctttggctgtgtctcttgggcagagggccaccatgtcctgcagagccggtgaaagtgttgatatttttggcgttgggtttttgcactggtaccagcagaaaccaggacagccacccaaactcctcatctatcgtgcatccaacctagaatctgggatccctgtcaggttcagtggcactgggtctaggacagacttcaccctcatcattgatcctgtggaggctgatgatgttgccacctattactgtcagcaaactaatgaggatccgtacacgttcggaggggggaccaagctggaaataaaaggcagtactagcggcggtggctccgggggcggttccggtgggggcggcagcagcgaggttcagctacaacagtctggggcagagcttgtggagccaggggcctcagtcaagttgtcctgcacagcttctggcttcaacattaaagacacctatatgcactgggtgaagcagaggcctgaacagggcctggaatggattggaaggattgatcctgcgaatggtaatagtaaatatgtcccgaagttccagggcaaggccactataacagcagacacatcttccaacacagcctacctgcagctcaccagcctgacatctgaggacactgccgtctattattgtgctccgtttggttactacgtgtctgactatgctatggcctactggggtcaaggaacctcagtcaccgtctcg

SEQ ID NO: 86 - protein, 1072 aa, Artificial Sequence
  Description of Artificial Sequence: Synthetic and Homo sapiens polypeptide
MATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLRDIVLTQSPASLAVSLGQRATMSCRAGESVDIFGVGFLHWYQQKPGQPPKLLIYRASNLESGIPVRFSGTGSRTDFTLIIDPVEADDVATYYCQQTNEDPYTFGGGTKLEIKGSTSGGGSGGGSGGGGSSEVQLQQSGAELVEPGASVKLSCTASGFNIKDTYMHWVKQRPEQGLEWIGR

SEQ ID NO: 87 - DNA, 3429 bp, Artificial Sequence
  Description of Artificial Sequence: Synthetic and Homo sapiens polynucleotide
atggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgcgacattgtgctgacccaatctccagcttctttggctgtgtctcttgggcagagggccaccatgtcctgcagagccggtgaaagtgttgatatttttggcgttgggtttttgcactggtaccagcagaaaccaggacagccacccaaactcctcatctatcgtgcatccaacctagaatctgggatccctgtcaggttcagtggcactgggtctaggacagacttcaccctcatcattgatcctgtggaggctgatgatgttgccacctattactgtcagcaaactaatgaggatccgtacacgttcggaggggggaccaagctggaaataaaaggcagtactagcggcggtggctccgggggcggttccggtgggggcggcagcagcgaggttcagctacaacagtctggggcagagcttgtggagccaggggcctcagtcaagttgtcctgcacagcttctggcttcaacattaaagacacctatatgcactgggtgaagcagaggcctgaacagggcctggaatggattggaaggattgatcctgcgaatggtaatagtaaatatgtcccgaagttccagggcaaggccactataacagcagacacatcttccaacacagcctacctgcagctcaccagcctgacatctgaggacactgccgtctattattgtgctccgtttggttactacgtgtctgactatgctatggcctactggggtcaaggaacctcagtcaccgtctcgtga

SEQ ID NO: 88 - protein, 1040 aa, Artificial Sequence
  Description of Artificial Sequence: Synthetic and Rattus norvegicus polypeptide
MATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQKDIVLTQSPASLAVSLGQRATMSCRAGESVDIFGVGFLHWYQQKPGQPPKLLIYRASNLESGIPVRFSGTGSRTDFTLIIDPVEADDVATYYCQQTNEDPYTFGGGTKLEIKGSTSGGGSGGGSGGGGSSEVQLQQSGAELVEPGASVKLSCTASGFNIKDTYMHWVKQRPEQGLEWIGR

SEQ ID NO: 89 - DNA, 3333 bp, Artificial Sequence
  Description of Artificial Sequence: Synthetic and Rattus norvegicus polynucleotide
atggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatcaacctcttcagcacagccttcgggttgctggggctggggtctgatggtcagccgccagcacagaaggacattgtgctgacccaatctccagcttctttggctgtgtctcttgggcagagggccaccatgtcctgcagagccggtgaaagtgttgatatttttggcgttgggtttttgcactggtaccagcagaaaccaggacagccacccaaactcctcatctatcgtgcatccaacctagaatctgggatccctgtcaggttcagtggcactgggtctaggacagacttcaccctcatcattgatcctgtggaggctgatgatgttgccacctattactgtcagcaaactaatgaggatccgtacacgttcggaggggggaccaagctggaaataaaaggcagtactagcggcggtggctccgggggcggttccggtgggggcggcagcagcgaggttcagctacaacagtctggggcagagcttgtggagccaggggcctcagtcaagttgtcctgcacagcttctggcttcaacattaaagacacctatatgcactgggtgaagcagaggcctgaacagggcctggaatggattggaaggattgatcctgcgaatggtaatagtaaatatgtcccgaagttccagggcaaggccactataacagcagacacatcttccaacacagcctacctgcagctcaccagcctgacatctgaggacactgccgtctattattgtgctccgtttggttactacgtgtctgactatgctatggcctactggggtcaaggaacctcagtcaccgtctcgtga

SEQ ID NO: 90 - protein, 56 aa, Homo sapiens
MGNSDSECPLSHDGYCLHDGVCMYIEALDKYACNCVVGYIGERCQYRDLKWWELRA

SEQ ID NO: 91 - DNA, 171 bp, Homo sapiens
atgggtaactctgactccgaatgcccgctgtctcacgacggttattgcctgcatgatggtgtttgtatgtatatcgaagctctggacaaatatgcttgcaactgtgttgttggttacatcggtgagcgttgccagtatcgcgacctgaaatggtgggaactgcgtgcatga

SEQ ID NO: 92 - protein, 949 aa, Artificial Sequence
  Description of Artificial Sequence: Synthetic and Homo sapiens polypeptide
MATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLRMGNSDSECPLSHDGYCLHDGVCMYIEALDKYACNCVVGYIGERCQYRDLKWWELRA

SEQ ID NO: 93 - DNA, 2850 bp, Artificial Sequence
  Description of Artificial Sequence: Synthetic and Homo sapiens polynucleotide
atggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgcatgggtaactctgactccgaatgcccgctgtctcacgacggttattgcctgcatgatggtgtttgtatgtatatcgaagctctggacaaatatgcttgcaactgtgttgttggttacatcggtgagcgttgccagtatcgcgacctgaaatggtgggaactgcgtgcatga

SEQ ID NO: 94 - protein, 917 aa, Artificial Sequence
  Description of Artificial Sequence: Synthetic Rattus norvegicus and Homo sapiens polypeptide
MATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQKMGNSDSECPLSHDGYCLHDGVCMYIEALDKYACNCVVGYIGERCQYRDLKWWELRA

SEQ ID NO: 95 - DNA, 2754 bp, Artificial Sequence
  Description of Artificial Sequence: Synthetic Rattus norvegicus and Homo sapiens polynucleotide
atggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatcaacctcttcagcacagccttcgggttgctggggctggggtctgatggtcagccgccagcacagaagatgggtaactctgactccgaatgcccgctgtctcacgacggttattgcctgcatgatggtgtttgtatgtatatcgaagctctggacaaatatgcttgcaactgtgttgttggttacatcggtgagcgttgccagtatcgcgacctgaaatggtgggaactgcgtgcatga

SEQ ID NO: 96 - protein, 1005 aa, Artificial Sequence
  Description of Artificial Sequence: Synthetic Saccaromyces Cerevisiae, Homo sapiens and Drosophila melanogaster polypeptide
MKLLSSIEQACDICRLKKLKCSKEKPKCAKCLKNNWECRYSPKTKRSPLTRAHLTEVESRLERLEQLFLLIFPREDLDMILKMDSLQDIKALLTGLMATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLRRQIKIWFQNARMKWKK

SEQ ID NO: 97 - DNA, 3018 bp, Artificial Sequence
  Description of Artificial Sequence: Synthetic Saccaromyces Cerevisiae, Homo sapiens and Drosophila melanogaster polynucleotide
atgaagctactgtcttctatcgaacaagcatgcgatatttgccgacttaaaaagctcaagtgctccaaagaaaaaccgaagtgcgccaagtgtctgaagaacaactgggagtgtcgctactctcccaaaaccaaaaggtctccgctgactagggcacatctgacagaagtggaatcaaggctagaaagactggaacagctatttctactgatttttcctcgagaagaccttgacatgattttgaaaatggattctttacaggatataaaagcattgttaacaggattaatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgccgacagatcaagatctggtttcagaacgcacggatgaagtggaagaagtga

SEQ ID NO: 98 - protein, 973 aa, Artificial Sequence
  Description of Artificial Sequence: Synthetic Saccaromyces Cerevisiae, Rattus norvegicus and Drosophila melanogaster polypeptide
MKLLSSIEQACDICRLKKLKCSKEKPKCAKCLKNNWECRYSPKTKRSPLTRAHLTEVESRLERLEQLFLLIFPREDLDMILKMDSLQDIKALLTGLMATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQKRQIKIWFQNARMKWKK

SEQ ID NO: 99 - DNA, 2922 bp, Artificial Sequence
  Description of Artificial Sequence: Synthetic Saccaromyces Cerevisiae, Rattus norvegicus and Drosophila melanogaster polynucleotide
atgaagctactgtcttctatcgaacaagcatgcgatatttgccgacttaaaaagctcaagtgctccaaagaaaaaccgaagtgcgccaagtgtctgaagaacaactgggagtgtcgctactctcccaaaaccaaaaggtctccgctgactagggcacatctgacagaagtggaatcaaggctagaaagactggaacagctatttctactgatttttcctcgagaagaccttgacatgattttgaaaatggattctttacaggatataaaagcattgttaacaggattaatggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatcaacctcttcagcacagccttcgggttgctggggctggggtctgatggtcagccgccagcacagaagcgacagatcaagatctggtttcagaacgcacggatgaagtggaagaagtga

SEQ ID NO: 100 - protein, 1238 aa, Artificial Sequence
  Description of Artificial Sequence: Synthetic, Saccaromyces cerevisiae and Homo sapiens polypeptide
MKLLSSIEQACDICRLKKLKCSKEKPKCAKCLKNNWECRYSPKTKRSPLTRAHLTEVESRLERLEQLFLLIFPREDLDMILKMDSLQDIKALLTGLMATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLRDIVLTQSPASLAVSLGQRATMSCRAGESVDIFGVGFLHWYQQKPGQPPKLLIYRASNLESGIPVRFSGTGSRTDFTLIIDPVEADDVATYYCQQTNEDPYTFGGGTKLEIKGSTSGGGSGGGSGGGGSSEVQLQQSGAELVEPGASVKLSCTASGFNIKDTYMHWVKQRPEQGLEWIGRIDPANGNSKYVPKFQGKATITADTSSNTAYLQLTSLTSEDTAVYYCAPFGYYVSDYAMAYWGQGTSVTVS

SEQ ID NO: 101 - DNA, 3717 bp, Artificial Sequence
  Description of Artificial Sequence: Synthetic, Saccaromyces cerevisiae and Homo sapiens polynucleotide
atgaagctactgtcttctatcgaacaagcatgcgatatttgccgacttaaaaagctcaagtgctccaaagaaaaaccgaagtgcgccaagtgtctgaagaacaactgggagtgtcgctactctcccaaaaccaaaaggtctccgctgactagggcacatctgacagaagtggaatcaaggctagaaagactggaacagctatttctactgatttttcctcgagaagaccttgacatgattttgaaaatggattctttacaggatataaaagcattgttaacaggattaatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgcgacattgtgctgacccaatctccagcttctttggctgtgtctcttgggcagagggccaccatgtcctgcagagccggtgaaagtgttgatatttttggcgttgggtttttgcactggtaccagcagaaaccaggacagccacccaaactcctcatctatcgtgcatccaacctagaatctgggatccctgtcaggttcagtggcactgggtctaggacagacttcaccctcatcattgatcctgtggaggctgatgatgttgccacctattactgtcagcaaactaatgaggatccgtacacgttcggaggggggaccaagctggaaataaaaggcagtactagcggcggtggctccgggggcggttccggtgggggcggcagcagcgaggttcagctacaacagtctggggcagagcttgtggagccaggggcctcagtcaagttgtcctgcacagcttctggcttcaacattaaagacacctatatgcactgggtgaagcagaggcctgaacagggcctggaatggattggaaggattgatcctgcgaatggtaatagtaaatatgtcccgaagttccagggcaaggccactataacagcagacacatcttccaacacagcctacctgcagctcaccagcctgacatctgaggacactgccgtctattattgtgctccgtttggttactacgtgtctgactatgctatggcctactggggtcaaggaacctcagtcaccgtctcgtga

SEQ ID NO: 102 - protein, 1206 aa, Artificial Sequence
  Description of Artificial Sequence: Synthetic, Saccaromyces cerevisiae and Rattus norvegicus polypeptide
MKLLSSIEQACDICRLKKLKCSKEKPKCAKCLKNNWECRYSPKTKRSPLTRAHLTEVESRLERLEQLFLLIFPREDLDMILKMDSLQDIKALLTGLMATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQKDIVLTQSPASLAVSLGQRATMSCRAGESVDIFGVGFLHWYQQKPGQPPKLLIYRASNLESGIPVRFSGTGSRTDFTLIIDPVEADDVATYYCQQTNEDPYTFGGGTKLEIKGSTSGGGSGGGSGGGGSSEVQLQQSGAELVEPGASVKLSCTASGFNIKDTYMHWVKQRPEQGLEWIGRIDPANGNSKYVPKFQGKATITADTSSNTAYLQLTSLTSEDTAVYYCAPFGYYVSDYAMAYWGQGTSVTVS

SEQ ID NO: 103 - DNA, 3621 bp, Artificial Sequence
  Description of Artificial Sequence: Synthetic, Saccaromyces cerevisiae and Rattus norvegicus polynucleotide
atgaagctactgtcttctatcgaacaagcatgcgatatttgccgacttaaaaagctcaagtgctccaaagaaaaaccgaagtgcgccaagtgtctgaagaacaactgggagtgtcgctactctcccaaaaccaaaaggtctccgctgactagggcacatctgacagaagtggaatcaaggctagaaagactggaacagctatttctactgatttttcctcgagaagaccttgacatgattttgaaaatggattctttacaggatataaaagcattgttaacaggattaatggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatcaacctcttcagcacagccttcgggttgctggggctggggtctgatggtcagccgccagcacagaaggacattgtgctgacccaatctccagcttctttggctgtgtctcttgggcagagggccaccatgtcctgcagagccggtgaaagtgttgatatttttggcgttgggtttttgcactggtaccagcagaaaccaggacagccacccaaactcctcatctatcgtgcatccaacctagaatctgggatccctgtcaggttcagtggcactgggtctaggacagacttcaccctcatcattgatcctgtggaggctgatgatgttgccacctattactgtcagcaaactaatgaggatccgtacacgttcggaggggggaccaagctggaaataaaaggcagtactagcggcggtggctccgggggcggttccggtgggggcggcagcagcgaggttcagctacaacagtctggggcagagcttgtggagccaggggcctcagtcaagttgtcctgcacagcttctggcttcaacattaaagacacctatatgcactgggtgaagcagaggcctgaacagggcctggaatggattggaaggattgatcctgcgaatggtaatagtaaatatgtcccgaagttccagggcaaggccactataacagcagacacatcttccaacacagcctacctgcagctcaccagcctgacatctgaggacactgccgtctattattgtgctccgtttggttactacgtgtctgactatgctatggcctactggggtcaaggaacctcagtcaccgtctcgtga

SEQ ID NO: 104 - protein, 1045 aa, Artificial Sequence
  Description of Artificial Sequence: Synthetic Saccaromyces cerevisiae and Homo sapiens polypeptide
MKLLSSIEQACDICRLKKLKCSKEKPKCAKCLKNNWECRYSPKTKRSPLTRAHLTEVESRLERLEQLFLLIFPREDLDMILKMDSLQDIKALLTGLMATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLRMGNSDSECPLSHDGYCLHDGVCMYIEALDKYACNCVVGYIGERCQYRDLKWWELRA

SEQ ID NO: 105 - DNA, 3138 bp, Artificial Sequence
  Description of Artificial Sequence: Synthetic Saccaromyces cerevisiae and Homo sapiens polynucleotide
atgaagctactgtcttctatcgaacaagcatgcgatatttgccgacttaaaaagctcaagtgctccaaagaaaaaccgaagtgcgccaagtgtctgaagaacaactgggagtgtcgctactctcccaaaaccaaaaggtctccgctgactagggcacatctgacagaagtggaatcaaggctagaaagactggaacagctatttctactgatttttcctcgagaagaccttgacatgattttgaaaatggattctttacaggatataaaagcattgttaacaggattaatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgcatgggtaactctgactccgaatgcccgctgtctcacgacggttattgcctgcatgatggtgtttgtatgtatatcgaagctctggacaaatatgcttgcaactgtgttgttggttacatcggtgagcgttgccagtatcgcgacctgaaatggtgggaactgcgtgcatga

SEQ ID NO: 106 - protein, 1013 aa, Artificial Sequence
  Description of Artificial Sequence: Synthetic Saccaromyces cerevisiae, Rattus norvegicus and Homo sapiens polypeptide
MKLLSSIEQACDICRLKKLKCSKEKPKCAKCLKNNWECRYSPKTKRSPLTRAHLTEVESRLERLEQLFLLIFPREDLDMILKMDSLQDIKALLTGLMATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQKMGNSDSECPLSHDGYCLHDGVCMYIEALDKYACNCVVGYIGERCQYRDLKWWELRA

SEQ ID NO: 107 - DNA, 3042 bp, Artificial Sequence
  Description of Artificial Sequence: Synthetic Saccaromyces cerevisiae, Rattus norvegicus and Homo sapiens polynucleotide
atgaagctactgtcttctatcgaacaagcatgcgatatttgccgacttaaaaagctcaagtgctccaaagaaaaaccgaagtgcgccaagtgtctgaagaacaactgggagtgtcgctactctcccaaaaccaaaaggtctccgctgactagggcacatctgacagaagtggaatcaaggctagaaagactggaacagctatttctactgatttttcctcgagaagaccttgacatgattttgaaaatggattctttacaggatataaaagcattgttaacaggattaatggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatcaacctcttcagcacagccttcgggttgctggggctggggtctgatggtcagccgccagcacagaagatgggtaactctgactccgaatgcccgctgtctcacgacggttattgcctgcatgatggtgtttgtatgtatatcgaagctctggacaaatatgcttgcaactgtgttgttggttacatcggtgagcgttgccagtatcgcgacctgaaatggtgggaactgcgtgcatga

SEQ ID NO: 108 - protein, 1000 aa, Artificial Sequence
  Description of Artificial Sequence: Synthetic Saccaromyces cerevisiae, Homo sapiens and Human immunodeficiency virus type 1 polypeptide
MKLLSSIEQACDICRLKKLKCSKEKPKCAKCLKNNWECRYSPKTKRSPLTRAHLTEVESRLERLEQLFLLIFPREDLDMILKMDSLQDIKALLTGLMATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLRYGRKKRRQRRR

SEQ ID NO: 109 - DNA, 3003 bp, Artificial Sequence
  Description of Artificial Sequence: Synthetic Saccaromyces cerevisiae, Homo sapiens and Human immunodeficiency virus type 1 polynucleotide
atgaagctactgtcttctatcgaacaagcatgcgatatttgccgacttaaaaagctcaagtgctccaaagaaaaaccgaagtgcgccaagtgtctgaagaacaactgggagtgtcgctactctcccaaaaccaaaaggtctccgctgactagggcacatctgacagaagtggaatcaaggctagaaagactggaacagctatttctactgatttttcctcgagaagaccttgacatgattttgaaaatggattctttacaggatataaaagcattgttaacaggattaatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctacgggcggaagaagcggcgacagaggcgacggtga

SEQ ID NO: 110 - protein, 968 aa, Artificial Sequence
  Description of Artificial Sequence: Synthetic Saccaromyces cerevisiae, Rattus norvegicus and Human immunodeficiency virus type 1 polypeptide
MKLLSSIEQACDICRLKKLKCSKEKPKCAKCLKNNWECRYSPKTKRSPLTRAHLTEVESRLERLEQLFLLIFPREDLDMILKMDSLQDIKALLTGLMATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQKYGRKKRRQRRR

SEQ ID NO: 111 - DNA, 2907 bp, Artificial Sequence
  Description of Artificial Sequence: Synthetic Saccaromyces cerevisiae, Rattus norvegicus and Human immunodeficiency virus type 1 polynucleotide
atgaagctactgtcttctatcgaacaagcatgcgatatttgccgacttaaaaagctcaagtgctccaaagaaaaaccgaagtgcgccaagtgtctgaagaacaactgggagtgtcgctactctcccaaaaccaaaaggtctccgctgactagggcacatctgacagaagtggaatcaaggctagaaagactggaacagctatttctactgatttttcctcgagaagaccttgacatgattttgaaaatggattctttacaggatataaaagcattgttaacaggattaatggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatcaacctcttcagcacagccttcgggttgctggggctggggtctgatggtcagccgccagcacagaagtacgggcggaagaagcggcgacagaggcgacggtga

SEQ ID NO: 112 - protein, 1040 aa, Artificial Sequence
  Description of Artificial Sequence: Synthetic Levivirus, Homo sapiens and Drosophila melanogaster polypeptide
MASNFTQFVLVDNGGTGDVTVAPSNFANGVAEWISSNSRSQAYKVTCSVRQSSAQNRKYTIKVEVPKVATQTVGGVELPVAAWRSYLNMELTIPIFATNSDCELIVKAMQGLLKDGNPIPSAIAANSGIYPMATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLRRQIKIWFQNARMKWKK

SEQ ID NO: 113 - DNA, 3123 bp, Artificial Sequence
  Description of Artificial Sequence: Synthetic Levivirus, Homo sapiens and Drosophila melanogaster polynucleotide
atggcttctaactttactcagttcgttctcgtcgacaatggcggaactggcgacgtgactgtcgccccaagcaacttcgctaacggggtcgctgaatggatcagctctaactcgcgttcacaggcttacaaagtaacctgtagcgttcgtcagagctctgcgcagaatcgcaaatacaccatcaaagtcgaggtgcctaaagtggcaacccagactgttggtggtgtagagcttcctgtagccgcatggcgttcgtacttaaatatggaactaaccattccaattttcgctacgaattccgactgcgagcttattgttaaggcaatgcaaggtctcctaaaagatggaaacccgattccctcagcaatcgcagcaaactccggcatctaccccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgccgacagatcaagatctggtttcagaacgcacggatgaagtggaagaagtga

SEQ ID NO: 114 - protein, 1008 aa, Artificial Sequence
  Description of Artificial Sequence: Synthetic Levivirus, Rattus norvegicus and Drosophila melanogaster polypeptide
MASNFTQFVLVDNGGTGDVTVAPSNFANGVAEWISSNSRSQAYKVTCSVRQSSAQNRKYTIKVEVPKVATQTVGGVELPVAAWRSYLNMELTIPIFATNSDCELIVKAMQGLLKDGNPIPSAIAANSGIYPMATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQKRQIKIWFQNARMKWKK

SEQ ID NO: 115 - DNA, 3027 bp, Artificial Sequence
  Description of Artificial Sequence: Synthetic Levivirus, Rattus norvegicus and Drosophila melanogaster polynucleotide
atggcttctaactttactcagttcgttctcgtcgacaatggcggaactggcgacgtgactgtcgccccaagcaacttcgctaacggggtcgctgaatggatcagctctaactcgcgttcacaggcttacaaagtaacctgtagcgttcgtcagagctctgcgcagaatcgcaaatacaccatcaaagtcgaggtgcctaaagtggcaacccagactgttggtggtgtagagcttcctgtagccgcatggcgttcgtacttaaatatggaactaaccattccaattttcgctacgaattccgactgcgagcttattgttaaggcaatgcaaggtctcctaaaagatggaaacccgattccctcagcaatcgcagcaaactccggcatctaccccatggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatcaacctcttcagcacagccttcgggttgctggggctggggtctgatggtcagccgccagcacagaagcgacagatcaagatctggtttcagaacgcacggatgaagtggaagaagtga

SEQ ID NO: 116 - protein, 1273 aa, Artificial Sequence
  Description of Artificial Sequence: Synthetic, Levivirus and Homo sapiens polypeptide
MASNFTQFVLVDNGGTGDVTVAPSNFANGVAEWISSNSRSQAYKVTCSVRQSSAQNRKYTIKVEVPKVATQTVGGVELPVAAWRSYLNMELTIPIFATNSDCELIVKAMQGLLKDGNPIPSAIAANSGIYPMATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLRDIVLTQSPASLAVSLGQRATMSCRAGESVDIFGVGFLHWYQQKPGQPPKLLIYRASNLESGIPVRFSGTGSRTDFTLIIDPVEADDVATYYCQQTNEDPYTFGGGTKLEIKGSTSGGGSGGGSGGGGSSEVQLQQSGAELVEPGASVKLSCTASGFNIKDTYMHWVKQRPEQGLEWIGRIDPANGNSKYVPKFQGKATITADTSSNTAYLQLTSLTSEDTAVYYCAPFGYYVSDYAMAYWGQGTSVTVS

SEQ ID NO: 117 - DNA, 3822 bp, Artificial Sequence
  Description of Artificial Sequence: Synthetic, Levivirus and Homo sapiens polynucleotide
atggcttctaactttactcagttcgttctcgtcgacaatggcggaactggcgacgtgactgtcgccccaagcaacttcgctaacggggtcgctgaatggatcagctctaactcgcgttcacaggcttacaaagtaacctgtagcgttcgtcagagctctgcgcagaatcgcaaatacaccatcaaagtcgaggtgcctaaagtggcaacccagactgttggtggtgtagagcttcctgtagccgcatggcgttcgtacttaaatatggaactaaccattccaattttcgctacgaattccgactgcgagcttattgttaaggcaatgcaaggtctcctaaaagatggaaacccgattccctcagcaatcgcagcaaactccggcatctaccccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgcgacattgtgctgacccaatctccagcttctttggctgtgtctcttgggcagagggccaccatgtcctgcagagccggtgaaagtgttgatatttttggcgttgggtttttgcactggtaccagcagaaaccaggacagccacccaaactcctcatctatcgtgcatccaacctagaatctgggatccctgtcaggttcagtggcactgggtctaggacagacttcaccctcatcattgatcctgtggaggctgatgatgttgccacctattactgtcagcaaactaatgaggatccgtacacgttcggaggggggaccaagctggaaataaaaggcagtactagcggcggtggctccgggggcggttccggtgggggcggcagcagcgaggttcagctacaacagtctggggcagagcttgtggagccaggggcctcagtcaagttgtcctgcacagcttctggcttcaacattaaagacacctatatgcactgggtgaagcagaggcctgaacagggcctggaatggattggaaggattgatcctgcgaatggtaatagtaaatatgtcccgaagttccagggcaaggccactataacagcagacacatcttccaacacagcctacctgcagctcaccagcctgacatctgaggacactgccgtctattattgtgctccgtttggttactacgtgtctgactatgctatggcctactggggtcaaggaacctcagtcaccgtctcgtga

SEQ ID NO: 118 - protein, 1241 aa, Artificial Sequence
  Description of Artificial Sequence: Synthetic, Levivirus and Rattus norvegicus polypeptide
MASNFTQFVLVDNGGTGDVTVAPSNFANGVAEWISSNSRSQAYKVTCSVRQSSAQNRKYTIKVEVPKVATQTVGGVELPVAAWRSYLNMELTIPIFATNSDCELIVKAMQGLLKDGNPIPSAIAANSGIYPMATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQKDIVLTQSPASLAVSLGQRATMSCRAGESVDIFGVGFLHWYQQKPGQPPKLLIYRASNLESGIPVRFSGTGSRTDFTLIIDPVEADDVATYYCQQTNEDPYTFGGGTKLEIKGSTSGGGSGGGSGGGGSSEVQLQQSGAELVEPGASVKLSCTASGFNIKDTYMHWVKQRPEQGLEWIGRIDPANGNSKYVPKFQGKATITADTSSNTAYLQLTSLTSEDTAVYYCAPFGYYVSDYAMAYWGQGTSVTVS

SEQ ID NO: 119 - DNA, 3726 bp, Artificial Sequence
  Description of Artificial Sequence: Synthetic, Levivirus and Rattus norvegicus polynucleotide
atggcttctaactttactcagttcgttctcgtcgacaatggcggaactggcgacgtgactgtcgccccaagcaacttcgctaacggggtcgctgaatggatcagctctaactcgcgttcacaggcttacaaagtaacctgtagcgttcgtcagagctctgcgcagaatcgcaaatacaccatcaaagtcgaggtgcctaaagtggcaacccagactgttggtggtgtagagcttcctgtagccgcatggcgttcgtacttaaatatggaactaaccattccaattttcgctacgaattccgactgcgagcttattgttaaggcaatgcaaggtctcctaaaagatggaaacccgattccctcagcaatcgcagcaaactccggcatctaccccatggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatcaacctcttcagcacagccttcgggttgctggggctggggtctgatggtcagccgccagcacagaaggacattgtgctgacccaatctccagcttctttggctgtgtctcttgggcagagggccaccatgtcctgcagagccggtgaaagtgttgatatttttggcgttgggtttttgcactggtaccagcagaaaccaggacagccacccaaactcctcatctatcgtgcatccaacctagaatctgggatccctgtcaggttcagtggcactgggtctaggacagacttcaccctcatcattgatcctgtggaggctgatgatgttgccacctattactgtcagcaaactaatgaggatccgtacacgttcggaggggggaccaagctggaaataaaaggcagtactagcggcggtggctccgggggcggttccggtgggggcggcagcagcgaggttcagctacaacagtctggggcagagcttgtggagccaggggcctcagtcaagttgtcctgcacagcttctggcttcaacattaaagacacctatatgcactgggtgaagcagaggcctgaacagggcctggaatggattggaaggattgatcctgcgaatggtaatagtaaatatgtcccgaagttccagggcaaggccactataacagcagacacatcttccaacacagcctacctgcagctcaccagcctgacatctgaggacactgccgtctattattgtgctccgtttggttactacgtgtctgactatgctatggcctactggggtcaaggaacctcagtcaccgtctcgtga

SEQ ID NO: 120 - protein, 1080 aa, Artificial Sequence
  Description of Artificial Sequence: Synthetic Levivirus and Homo sapiens polypeptide
MASNFTQFVLVDNGGTGDVTVAPSNFANGVAEWISSNSRSQAYKVTCSVRQSSAQNRKYTIKVEVPKVATQTVGGVELPVAAWRSYLNMELTIPIFATNSDCELIVKAMQGLLKDGNPIPSAIAANSGIYPMATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLRMGNSDSECPLSHDGYCLHDGVCMYIEALDKYACNCVVGYIGERCQYRDLKWWELRA

SEQ ID NO: 121 - DNA, 3243 bp, Artificial Sequence
  Description of Artificial Sequence: Synthetic Levivirus and Homo sapiens polynucleotide
atggcttctaactttactcagttcgttctcgtcgacaatggcggaactggcgacgtgactgtcgccccaagcaacttcgctaacggggtcgctgaatggatcagctctaactcgcgttcacaggcttacaaagtaacctgtagcgttcgtcagagctctgcgcagaatcgcaaatacaccatcaaagtcgaggtgcctaaagtggcaacccagactgttggtggtgtagagcttcctgtagccgcatggcgttcgtacttaaatatggaactaaccattccaattttcgctacgaattccgactgcgagcttattgttaaggcaatgcaaggtctcctaaaagatggaaacccgattccctcagcaatcgcagcaaactccggcatctaccccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgcatgggtaactctgactccgaatgcccgctgtctcacgacggttattgcctgcatgatggtgtttgtatgtatatcgaagctctggacaaatatgcttgcaactgtgttgttggttacatcggtgagcgttgccagtatcgcgacctgaaatggtgggaactgcgtgcatga

SEQ ID NO: 122 - protein, 1048 aa, Artificial Sequence
  Description of Artificial Sequence: Synthetic Levivirus, Rattus norvegicus and Homo sapiens polypeptide
MASNFTQFVLVDNGGTGDVTVAPSNFANGVAEWISSNSRSQAYKVTCSVRQSSAQNRKYTIKVEVPKVATQTVGGVELPVAAWRSYLNMELTIPIFATNSDCELIVKAMQGLLKDGNPIPSAIAANSGIYPMATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQKMGNSDSECPLSHDGYCLHDGVCMYIEALDKYACNCVVGYIGERCQYRDLKWWELRA

SEQ ID NO: 123 - DNA, 3147 bp, Artificial Sequence
  Description of Artificial Sequence: Synthetic Levivirus, Rattus norvegicus and Homo sapiens polynucleotide
atggcttctaactttactcagttcgttctcgtcgacaatggcggaactggcgacgtgactgtcgccccaagcaacttcgctaacggggtcgctgaatggatcagctctaactcgcgttcacaggcttacaaagtaacctgtagcgttcgtcagagctctgcgcagaatcgcaaatacaccatcaaagtcgaggtgcctaaagtggcaacccagactgttggtggtgtagagcttcctgtagccgcatggcgttcgtacttaaatatggaactaaccattccaattttcgctacgaattccgactgcgagcttattgttaaggcaatgcaaggtctcctaaaagatggaaacccgattccctcagcaatcgcagcaaactccggcatctaccccatggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatcaacctcttcagcacagccttcgggttgctggggctggggtctgatggtcagccgccagcacagaagatgggtaactctgactccgaatgcccgctgtctcacgacggttattgcctgcatgatggtgtttgtatgtatatcgaagctctggacaaatatgcttgcaactgtgttgttggttacatcggtgagcgttgccagtatcgcgacctgaaatggtgggaactgcgtgcatga

SEQ ID NO: 124 - protein, 1035 aa, Artificial Sequence
  Description of Artificial Sequence: Synthetic Levivirus, Homo sapiens and Human immunodeficiency virus type 1 polypeptide
MASNFTQFVLVDNGGTGDVTVAPSNFANGVAEWISSNSRSQAYKVTCSVRQSSAQNRKYTIKVEVPKVATQTVGGVELPVAAWRSYLNMELTIPIFATNSDCELIVKAMQGLLKDGNPIPSAIAANSGIYPMATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLRYGRKKRRQRRR

SEQ ID NO: 125 - DNA, 3108 bp, Artificial Sequence
  Description of Artificial Sequence: Synthetic Levivirus, Homo sapiens and Human immunodeficiency virus type 1 polynucleotide
atggcttctaactttactcagttcgttctcgtcgacaatggcggaactggcgacgtgactgtcgccccaagcaacttcgctaacggggtcgctgaatggatcagctctaactcgcgttcacaggcttacaaagtaacctgtagcgttcgtcagagctctgcgcagaatcgcaaatacaccatcaaagtcgaggtgcctaaagtggcaacccagactgttggtggtgtagagcttcctgtagccgcatggcgttcgtacttaaatatggaactaaccattccaattttcgctacgaattccgactgcgagcttattgttaaggcaatgcaaggtctcctaaaagatggaaacccgattccctcagcaatcgcagcaaactccggcatctaccccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctacgggcggaagaagcggcgacagaggcgacggtga

SEQ ID NO: 126 - protein, 1003 aa, Artificial Sequence
  Description of Artificial Sequence: Synthetic Levivirus, Rattus norvegicus and Human immunodeficiency virus type 1 polypeptide
MASNFTQFVLVDNGGTGDVTVAPSNFANGVAEWISSNSRSQAYKVTCSVRQSSAQNRKYTIKVEVPKVATQTVGGVELPVAAWRSYLNMELTIPIFATNSDCELIVKAMQGLLKDGNPIPSAIAANSGIYPMATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQKYGRKKRRQRRR

SEQ ID NO: 127 - DNA, 3012 bp, Artificial Sequence
  Description of Artificial Sequence: Synthetic Levivirus, Rattus norvegicus and Human immunodeficiency virus type 1 polynucleotide
atggcttctaactttactcagttcgttctcgtcgacaatggcggaactggcgacgtgactgtcgccccaagcaacttcgctaacggggtcgctgaatggatcagctctaactcgcgttcacaggcttacaaagtaacctgtagcgttcgtcagagctctgcgcagaatcgcaaatacaccatcaaagtcgaggtgcctaaagtggcaacccagactgttggtggtgtagagcttcctgtagccgcatggcgttcgtacttaaatatggaactaaccattccaattttcgctacgaattccgactgcgagcttattgttaaggcaatgcaaggtctcctaaaagatggaaacccgattccctcagcaatcgcagcaaactccggcatctaccccatggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatcaacctcttcagcacagccttcgggttgctggggctggggtctgatggtcagccgccagcacagaagtacgggcggaagaagcggcgacagaggcgacggtga

SEQ ID NO: 128 - protein, 926 aa, Artificial Sequence
  Description of Artificial Sequence: Synthetic, Homo sapiens and Drosophila melanogaster polypeptide
MKKKKKKKKKKKKKKKPMATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLRRQIKIWFQNARMKWKK

SEQ ID NO: 129 - DNA, 2781 bp, Artificial Sequence
  Description of Artificial Sequence: Synthetic, Homo sapiens and Drosophila melanogaster polynucleotide
atgaagaagaagaagaagaagaagaagaagaagaagaagaagaagaagcccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgccgacagatcaagatctggtttcagaacgcacggatgaagtggaagaagtga

SEQ ID NO: 130 - protein, 894 aa, Artificial Sequence
  Description of Artificial Sequence: Synthetic, Rattus norvegicus and Drosophila melanogaster polypeptide
MKKKKKKKKKKKKKKKPMATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQKRQIKIWFQNARMKWKK

SEQ ID NO: 131 - DNA, 2685 bp, Artificial Sequence
  Description of Artificial Sequence: Synthetic, Rattus norvegicus and Drosophila melanogaster polynucleotide
atgaagaagaagaagaagaagaagaagaagaagaagaagaagaagaagcccatggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatcaacctcttcagcacagccttcgggttgctggggctggggtctgatggtcagccgccagcacagaagcgacagatcaagatctggtttcagaacgcacggatgaagtggaagaagtga

SEQ ID NO: 132 - protein, 1159 aa, Artificial Sequence
  Description of Artificial Sequence: Synthetic and Homo sapiens polypeptide
MKKKKKKKKKKKKKKKPMATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLRDIVLTQSPASLAVSLGQRATMSCRAGESVDIFGVGFLHWYQQKPGQPPKLLIYRASNLESGIPVRFSGTGSRTDFTLIIDPVEADDVATYYCQQTNEDPYTFGGGTKLEIKGSTSGGGSGGGSGGGGSSEVQLQQSGAELVEPGASVKLSCTASGFNIKDTYMHWVKQRPEQGLEWIGRIDPANGNSKYVPKFQGKATITADTSSNTAYLQLTSLTSEDTAVYYCAPFGYYVSDYAMAYWGQGTSVTVS

SEQ ID NO: 133 - DNA, 3480 bp, Artificial Sequence
  Description of Artificial Sequence: Synthetic and Homo sapiens polynucleotide
atgaagaagaagaagaagaagaagaagaagaagaagaagaagaagaagcccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgcgacattgtgctgacccaatctccagcttctttggctgtgtctcttgggcagagggccaccatgtcctgcagagccggtgaaagtgttgatatttttggcgttgggtttttgcactggtaccagcagaaaccaggacagccacccaaactcctcatctatcgtgcatccaacctagaatctgggatccctgtcaggttcagtggcactgggtctaggacagacttcaccctcatcattgatcctgtggaggctgatgatgttgccacctattactgtcagcaaactaatgaggatccgtacacgttcggaggggggaccaagctggaaataaaaggcagtactagcggcggtggctccgggggcggttccggtgggggcggcagcagcgaggttcagctacaacagtctggggcagagcttgtggagccaggggcctcagtcaagttgtcctgcacagcttctggcttcaacattaaagacacctatatgcactgggtgaagcagaggcctgaacagggcctggaatggattggaaggattgatcctgcgaatggtaatagtaaatatgtcccgaagttccagggcaaggccactataacagcagacacatcttccaacacagcctacctgcagctcaccagcctgacatctgaggacactgccgtctattattgtgctccgtttggttactacgtgtctgactatgctatggcctactggggtcaaggaacctcagtcaccgtctcgtga

SEQ ID NO: 134 - protein, 1127 aa, Artificial Sequence
  Description of Artificial Sequence: Synthetic and Rattus norvegicus polypeptide
MKKKKKKKKKKKKKKKPMATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQKDIVLTQSPASLAVSLGQRATMSCRAGESVDIFGVGFLHWYQQKPGQPPKLLIYRASNLESGIPVRFSGTGSRTDFTLIIDPVEADDVATYYCQQTNEDPYTFGGGTKLEIKGSTSGGGSGGGSGGGGSSEVQLQQSGAELVEPGASVKLSCTASGFNIKDTYMHWVKQRPEQGLEWIGRIDPANGNSKYVPKFQGKATITADTSSNTAYLQLTSLTSEDTAVYYCAPFGYYVSDYAMAYWGQGTSVTVS

SEQ ID NO: 135 - DNA, 3384 bp, Artificial Sequence
  Description of Artificial Sequence: Synthetic and Rattus norvegicus polynucleotide
atgaagaagaagaagaagaagaagaagaagaagaagaagaagaagaagcccatggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatcaacctcttcagcacagccttcgggttgctggggctggggtctgatggtcagccgccagcacagaaggacattgtgctgacccaatctccagcttctttggctgtgtctcttgggcagagggccaccatgtcctgcagagccggtgaaagtgttgatatttttggcgttgggtttttgcactggtaccagcagaaaccaggacagccacccaaactcctcatctatcgtgcatccaacctagaatctgggatccctgtcaggttcagtggcactgggtctaggacagacttcaccctcatcattgatcctgtggaggctgatgatgttgccacctattactgtcagcaaactaatgaggatccgtacacgttcggaggggggaccaagctggaaataaaaggcagtactagcggcggtggctccgggggcggttccggtgggggcggcagcagcgaggttcagctacaacagtctggggcagagcttgtggagccaggggcctcagtcaagttgtcctgcacagcttctggcttcaacattaaagacacctatatgcactgggtgaagcagaggcctgaacagggcctggaatggattggaaggattgatcctgcgaatggtaatagtaaatatgtcccgaagttccagggcaaggccactataacagcagacacatcttccaacacagcctacctgcagctcaccagcctgacatctgaggacactgccgtctattattgtgctccgtttggttactacgtgtctgactatgctatggcctactggggtcaaggaacctcagtcaccgtctcgtga

SEQ ID NO: 136 - protein, 966 aa, Artificial Sequence
  Description of Artificial Sequence: Synthetic and Homo sapiens polypeptide
MKKKKKKKKKKKKKKKPMATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLRMGNSDSECPLSHDGYCLHDGVCMYIEALDKYACNCVVGYIGERCQYRDLKWWELRA

SEQ ID NO: 137 - DNA, 2901 bp, Artificial Sequence
  Description of Artificial Sequence: Synthetic and Homo sapiens polynucleotide
atgaagaagaagaagaagaagaagaagaagaagaagaagaagaagaagcccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgcatgggtaactctgactccgaatgcccgctgtctcacgacggttattgcctgcatgatggtgtttgtatgtatatcgaagctctggacaaatatgcttgcaactgtgttgttggttacatcggtgagcgttgccagtatcgcgacctgaaatggtgggaactgcgtgcatga

SEQ ID NO: 138 - protein, 934 aa, Artificial Sequence
  Description of Artificial Sequence: Synthetic, Rattus norvegicus and Homo sapiens polypeptide
MKKKKKKKKKKKKKKKPMATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQKMGNSDSECPLSHDGYCLHDGVCMYIEALDKYACNCVVGYIGERCQYRDLKWWELRA

SEQ ID NO: 139 - DNA, 2805 bp, Artificial Sequence
  Description of Artificial Sequence: Synthetic, Rattus norvegicus and Homo sapiens polynucleotide
atgaagaagaagaagaagaagaagaagaagaagaagaagaagaagaagcccatggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatcaacctcttcagcacagccttcgggttgctggggctggggtctgatggtcagccgccagcacagaagatgggtaactctgactccgaatgcccgctgtctcacgacggttattgcctgcatgatggtgtttgtatgtatatcgaagctctggacaaatatgcttgcaactgtgttgttggttacatcggtgagcgttgccagtatcgcgacctgaaatggtgggaactgcgtgcatga

SEQ ID NO: 140 - protein, 921 aa, Artificial Sequence
  Description of Artificial Sequence: Synthetic, Homo sapiens and Human immunodeficiency virus type 1 polypeptide
MKKKKKKKKKKKKKKKPMATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLRYGRKKRRQRRR

SEQ ID NO: 141 - DNA, 2766 bp, Artificial Sequence
  Description of Artificial Sequence: Synthetic, Homo sapiens and Human immunodeficiency virus type 1 polynucleotide
atgaagaagaagaagaagaagaagaagaagaagaagaagaagaagaagcccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctacgggcggaagaagcggcgacagaggcgacggtga

SEQ ID NO: 142 - protein, 889 aa, Artificial Sequence
  Description of Artificial Sequence: Synthetic, Rattus norvegicus and Human immunodeficiency virus type 1 polypeptide
MKKKKKKKKKKKKKKKPMATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQKYGRKKRRQRRR

SEQ ID NO: 143 - DNA, 2670 bp, Artificial Sequence
  Description of Artificial Sequence: Synthetic, Rattus norvegicus and Human immunodeficiency virus type 1 polynucleotide
atgaagaagaagaagaagaagaagaagaagaagaagaagaagaagaagcccatggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatcaacctcttcagcacagccttcgggttgctggggctggggtctgatggtcagccgccagcacagaagtacgggcggaagaagcggcgacagaggcgacggtga

SEQ ID NO: 144 - protein, 33 aa, Artificial Sequence
  Description of Artificial Sequence: Synthetic polypeptide
FNMQQQRRFYEALHDPNLNEEQRNAKIKSIRDD

SEQ ID NO: 145 - protein, 894 aa, Artificial Sequence
  Description of Artificial Sequence: Synthetic polypeptide
MATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQKFNMQQQRRFYEALHDPNLNEEQRNAKIKSIRDD

SEQ ID NO: 146 - DNA, 1146 bp, Chlamydia muridarum
ctgcctgtggggaatcctgctgaaccaagccttatgattgacgggattctttgggaaggtttcggtggagatccttgcgatccttgcacaacttggtgtgatgccatcagcctacgtctcggctactacggggacttcgtttttgatcgcgttttgaaaacagacgtaaacaaacagttcgaaatgggacccgttcctacaacaacagatactgatgctgctgcagatataacgacatctacaccaagagagaatcctgcttatggtaaacatatgcaagacgcggagatgttcactaacgctgcatacatggctttgaatatttgggaccgtttcgatgtattttgtacattaggagcaactagcggttacctcaaagggaattcagcttccttcaacttagttggattatttggggatggtgtagcaaacgctgcaaacgcaattgctactgttgcagcagactctttacctaacgtaagtttgtcacaagccgttgttgagctttatacagacactgcttttgcttggagcgttggtgctagagcagctttatgggagtgtggatgtgccactttaggagcttccttccaatatgctcaatctaagccaaaagtggaagaattaaacgttctctgtaatgcggcacaattcactattaacaagcctaaaggatatgttggaaaagaatttcctcttgcccttacagcgggaacagatagcgctacagacactaaagatgcttccatcgattaccatgaatggcaagcaagcttagctttgtcttacagactgaatatgttcactccttacatcggagttaaatggtctagagcaagctttgatgcagacacgatccgtattgcgcagcctaagttagcagaagcgattttagatgttacaacatggaacccaacgatcgctggagctggtactatagcagacggtactggtgctgctgctactgccaacggacttgcagatacattacaaattgtttccttgcagctcaacaagatgaaatccagaaaatcttgcggtcttgcaattggaacaacaattgtagatgctgataaatatgcagttactgttgagacacgcttgatcgatgaaagagcagctcacgtaaatgctcagttccgtttc

SEQ ID NO: 147 - protein, 382 aa, Chlamydia muridarum
LPVGNPAEPSLMIDGILWEGFGGDPCDPCTTWCDAISLRLGYYGDFVFDRVLKTDVNKQFEMGPVPTTTDTDAAADITTSTPRENPAYGKHMQDAEMFTNAAYMALNIWDRFDVFCTLGATSGYLKGNSASFNLVGLFGDGVANAANAIATVAADSLPNVSLSQAVVELYTDTAFAWSVGARAALWECGCATLGASFQYAQSKPKVEELNVLCNAAQFTINKPKGYVGKEFPLALTAGTDSATDTKDASIDYHEWQASLALSYRLNMFTPYIGVKWSRASFDADTIRIAQPKLAEAILDVTTWNPTIAGAGTIADGTGAAATANGLADTLQIVSLQLNKMKSRKSCGLAIGTTIVDADKYAVTVETRLIDERAAHVNAQFRF

SEQ ID NO: 148 - protein, 636 aa, Artificial Sequence [sequence omitted]

What is claimed is:

1. A pharmaceutical composition for immunizing a subject against *C. trachomatis* genital infection, comprising a Chlamydial immunogenic peptide or an immunogenic fragment or variant thereof incorporated within a vault-like particle, and at least one pharmaceutically acceptable excipient, wherein the vault-like particle comprises MVP.

2. The pharmaceutical composition of claim 1, wherein the vault-like particle further comprises VPARP or modified VPARP, or a portion of VPARP or a modified portion of VPARP.

3. The pharmaceutical composition of claim 1, wherein the MVP is modified by the addition of an amino acid sequence added to the N-terminal of the MVP.

4. The pharmaceutical composition of claim 3, wherein the immunogenic peptide or immunogenic fragment or variant thereof resides within the vault-like particle.

5. The pharmaceutical composition of claim 1, wherein the immunogenic peptide is MOMP.

* * * * *